(12) United States Patent
Ganesan et al.

(10) Patent No.: US 12,077,585 B2
(45) Date of Patent: Sep. 3, 2024

(54) PROTEINS COMPRISING KALLIKREIN RELATED PEPTIDASE 2 ANTIGEN BINDING DOMAINS AND THEIR USES

(71) Applicant: Janssen Biotech, Inc., Horsham, PA (US)

(72) Inventors: Rajkumar Ganesan, Blue Bell, PA (US); John Lee, North Wales, PA (US); Jinquan Luo, Malvern, PA (US); Theresa McDevitt, Warminster, PA (US); Fei Shen, Collegeville, PA (US); Degang Song, Wynnewood, PA (US); Raymond Brittingham, Spring House, PA (US); Sathyadevi Venkataramani, Blue Bell, PA (US); Sanjaya Singh, Blue Bell, PA (US); Yonghong Zhao, Eagleville, PA (US); Fang Yi, Collegeville, PA (US); Sherry Lynn La Porte, Horsham, PA (US)

(73) Assignee: Janssen Biotech, Inc., Horsham, PA (US)

(*) Notice: Subject to any disclaimer, the term of this patent is extended or adjusted under 35 U.S.C. 154(b) by 88 days.

(21) Appl. No.: 16/937,285

(22) Filed: Jul. 23, 2020

(65) Prior Publication Data
US 2021/0040210 A1  Feb. 11, 2021

Related U.S. Application Data

(60) Provisional application No. 63/030,445, filed on May 27, 2020, provisional application No. 62/910,650, filed on Oct. 4, 2019, provisional application No. 62/878,964, filed on Jul. 26, 2019.

(51) Int. Cl.
*C07K 16/28* (2006.01)
*C07K 16/34* (2006.01)

(52) U.S. Cl.
CPC .......... *C07K 16/2809* (2013.01); *C07K 16/34* (2013.01); *C07K 2317/14* (2013.01); *C07K 2317/31* (2013.01); *C07K 2317/565* (2013.01)

(58) Field of Classification Search
None
See application file for complete search history.

(56) References Cited

U.S. PATENT DOCUMENTS

| | | |
|---|---|---|
| 3,832,253 A | 8/1974 | Palma et al. |
| 3,854,480 A | 12/1974 | Zaffaroni |
| 4,452,775 A | 6/1984 | Kent |
| 4,667,014 A | 5/1987 | Nestor et al. |
| 4,683,195 A | 7/1987 | Mullis et al. |
| 4,748,034 A | 5/1988 | De Rham |
| 5,075,109 A | 12/1991 | Tice et al. |
| 5,225,539 A | 7/1993 | Winter |
| 5,239,660 A | 8/1993 | Ooi |
| 5,635,483 A | 6/1997 | Pettit et al. |
| 5,780,588 A | 7/1998 | Pettit et al. |
| 5,932,448 A | 8/1999 | Tso et al. |
| 6,150,584 A | 11/2000 | Kucherlapati et al. |
| 6,818,749 B1 | 11/2004 | Kashmiri et al. |
| 6,833,441 B2 | 12/2004 | Wang et al. |
| 7,709,226 B2 | 5/2010 | Foote |
| 8,748,356 B2 | 6/2014 | Raghunathan |
| 9,150,663 B2 | 10/2015 | Labrijn et al. |
| 9,345,782 B2 | 5/2016 | Strand et al. |
| 10,100,125 B2 | 10/2018 | Timmermand et al. |
| 2002/0155537 A1 | 10/2002 | Carter et al. |
| 2007/0218047 A1* | 9/2007 | Golz .................. G01N 33/5008 514/17.7 |
| 2009/0182127 A1 | 7/2009 | Naergaard et al. |
| 2010/0015133 A1 | 1/2010 | Igawa et al. |
| 2010/0028637 A1 | 2/2010 | Tavsanli et al. |
| 2010/0261620 A1 | 10/2010 | Almagro et al. |
| 2011/0123532 A1 | 5/2011 | Gurney et al. |
| 2012/0149876 A1 | 6/2012 | Von et al. |
| 2013/0195849 A1 | 8/2013 | Spreter et al. |
| 2014/0273092 A1 | 9/2014 | Goochee et al. |
| 2014/0303356 A1 | 10/2014 | Gramer et al. |
| 2018/0118849 A1 | 5/2018 | Klein et al. |
| 2018/0326102 A1 | 11/2018 | Ulmert |
| 2020/0048349 A1 | 2/2020 | Gaudet et al. |

FOREIGN PATENT DOCUMENTS

| | | |
|---|---|---|
| CN | 104640562 A | 5/2015 |
| EP | 0451216 B1 | 1/1996 |
| GB | 2520353 A | 5/2015 |
| WO | 90/04036 A1 | 4/1990 |
| WO | 90/07861 A1 | 7/1990 |
| WO | 92/22653 A1 | 12/1992 |

(Continued)

OTHER PUBLICATIONS

Baert et al., New England Journal of Medicine, 2003, 348, 602-608.
Bird et al., 1988, Science 242:423-426.
Cai et al 2011 Biotechnol Bioeng 108, 404-412.
Chothia et al., I. Mol. Biol., 1987, 196, 901-917.
Fairhead & Howarth, Methods Mol Biol (2015); 1266: 171-184.
Ferrara et al, Biotechnol Bioeng 93:851-861, 2006.
Ferrara et al, JBiol Chem 281:5032-5036, 2006.

(Continued)

*Primary Examiner* — Brad Duffy

(74) *Attorney, Agent, or Firm* — BakerHostetler

(57) ABSTRACT

Embodiments of the present invention provide isolated proteins comprising antigen binding domains that bind kallikrein related peptidase 2 (hK2), including monospecific and bispecific antibodies. Additional embodiments of the invention provide polynucleotides encoding the hk2-specific proteins, vectors, host cells, and methods of making and using them.

96 Claims, 81 Drawing Sheets

Specification includes a Sequence Listing.

(56) References Cited

FOREIGN PATENT DOCUMENTS

| | | | |
|---|---|---|---|
| WO | 96/27011 A1 | 9/1996 |
| WO | 98/02748 A1 | 1/1998 |
| WO | 99/45962 A1 | 9/1999 |
| WO | 2002/043478 A2 | 6/2002 |
| WO | 2002/066630 A1 | 8/2002 |
| WO | 2002/088172 A2 | 11/2002 |
| WO | 2008/077546 A1 | 7/2008 |
| WO | 2009/085462 A1 | 7/2009 |
| WO | 2009/134776 A2 | 11/2009 |
| WO | 2010/080833 A1 | 7/2010 |
| WO | 2011/123708 A2 | 10/2011 |
| WO | 2011/143545 A1 | 11/2011 |
| WO | 2012/022811 A1 | 2/2012 |
| WO | 2013/096291 A2 | 6/2013 |
| WO | 2013/157954 A1 | 10/2013 |
| WO | 2014/012085 A2 | 1/2014 |
| WO | 2014/093908 A2 | 6/2014 |
| WO | 2015/075445 A1 | 5/2015 |
| WO | 2016/109774 A1 | 7/2016 |
| WO | 2016/132366 A1 | 8/2016 |
| WO | 2017/055391 A1 | 4/2017 |
| WO | 2018/200582 A1 | 10/2018 |
| WO | 2019/060695 A1 | 3/2019 |
| WO | 2019/224717 A2 | 11/2019 |
| WO | 2021/019386 A1 | 2/2021 |
| WO | 2021/019389 A1 | 2/2021 |
| WO | 2022/162549 A2 | 8/2022 |

OTHER PUBLICATIONS

Finlay et al., "Development of a dual monoclonal antibody immunoassay for total human kallikrein 2", Clinical Chemistry, Jul. 1, 2001, vol. 47, No. 7, 1218-1224.
Gadi et al., Gene Ther., 2000, 7, 1738-1743.
Honegger and Pluckthun, J Mol Biol (2001) 309:657-70.
Huston et al., Proc. Natl. Acad. Sci. USA, 1988, 85, 5879-5883.
Kabat et al., Sequences of Proteins of Immunological Interest, 5th Ed. Public Health Service, National Institutes of Health, Bethesda, Md., 1991).
Kjer-Nielsen, L. et al.; Proc Natl Acad Sci USA 101, 7675-7680.
Knappik et al., (2000) J Mol Biol 296:57-86.
Konno etal., Cytotechnology 641:249-65, 2012.
LeFranc et al., Dev. Comp. Immunol., 2003, 27, 55-77.
MacLennan et al., Acta Physiol Scand Suppl, 1988, 643, 55-67.
Martin et al., J. Bmol. Biol., 1996, 263, 800-815.
Meyers and W. Miller (Coinput Appl Biosci 4:11-17 (1988)).
Mori et al., Biotechnol Bioeng, 2004, 88, 901-908.
Needleman and Wunsch JMol Biol 48:444-453 (1970)).
Okayama and Berg, Mol. Cell. Biol., 1983, 3, 280.
Olivier et al., MABs, 2010, 2(4), 405-415.
Padlan, Mol Immunol, 1991, 28, 489-499.
Piironen et al., "Determination and analysis of antigenic epitopes of prostate specific antigen (PSA) and human glandular kallikrein 2 (hK2) using synthetic peptides and computer modeling", Protein Science, Wiley US, Feb. 1, 1998, vol. 7, No. 2, 259-269.
Sasaki et al., Adv. Biophys., 1988, 35, 1-24.
Shi et al., J. Mol. Biol., 2010, 397, 385-396.
Shields et al., J. Biol. Chem., 2002, 277, 26733-26740.
Shinkawa et al., J. Biol Chem., 2003, 278, 3466-3473.
Singh et al., Mabs, 2015, 7(4), 778-791.
Skala et al., "Structure-Function Analysis of Human Kallikrein-related Peptidase 2 Establish the 99-Loop as Master Regulator of Activity", Journal of Biological Chemistry, Oct. 16, 2014, vol. 289, No. 49, 34267-34283.
Stickler et al., Genes and Immunity, 2011, 12, 213-221.
Ward et al., Nature, 1989, 341, 544-546.
Woyke et al., Antimicrob Agents and Chemother, 2001, 45(12), 3580-3584.
Wu et al., J. Exp. Med., 1970, 132, 211-250.
Yu et al., "Cart Cell therapy for prostate cancer: status and promise", Oncotargets and therapy, Jan. 1, 2019, vol. 12, pp. 391-395.
Zhou et al., Biotechnol. Bioeng., 2008, 99, 652-665.
Kim et al., "Heterodimeric CD3 ?? extracellular domain fragments: production, purification and structural analysis1.", Journal of Molecular Biology, Sep. 29, 2000, vol. 302, No. 4, pp. 899-916.
Osborn et al., "High-Affinity IgG Antibodies Develop Naturally in Ig-Knockout Rats Carrying Germline Human IgH/Ig?/Ig? Loci Bearing the Rat CH Region.", J. Immunology, 2013, vol. 190, pp. 1481-1490.
Rosenberg et al., "Use of Tumor-Infiltrating Lymphocytes and Interleukin-2 in the Immunotherapy of Patients with Metastatic Melanoma", The New England Journal of Medicine, Dec. 22, 1988, vol. 319, pp. 1676-1680.
Vaisanen et al., "Development of Sensitive Immunoassays for Free and Total Human Glandular Kallikrein 2", Clinical Chemistry, 2004, vol. 50, No. 9, pp. 1607-1617.
McDevitt et al., "Feed-forward alpha particle radiotherapy ablates androgen receptor-addicted prostate cancer", Nature Communications, 2018, vol. 9, Article No. 1629, pp. 1-11.

* cited by examiner

FIG.1

```
                1                                             45
mu11B6_VH   DVQLQESGPGLVKPSQSLSLTCTVTGNSITSDYAWNWIRQFPGNR
hu11B6_VH   QVQLQESGPGLVKPSDTLSLTCAVSGNSITSDYAWNWIRQPPGKG
KL2B357_VH  QVQLQESGPGLVKPSQTLSLTCTVSGNSITSDYAWNWIRQFPGKG
KL2B358_VH  QVQLQESGPGLVKPSQTLSLTCTVSGNSITSDYAWNWIRQPPGKG
KL2B359_VH  QVQLQESGPGLVKPSQTLSLTCTVSGNSITSDYAWNWIRQFPGKR
KL2B360_VH  QVQLQESGPGLVKPSQTLSLTCTVSGNSITSDYAWNWIRQFPGKG
     HCF3   QVQLQESGPGLVKPSDTLSLTCAVSGNSITSDYAWNWIRQFPGKG
     HCG5   QVQLQESGPGLVKPSDTLSLTCAVSGNSITSDYAWNWIRQFPGKG
      Aln   :***********.:****:*:************* **:

46                                            90
mu11B6_VH   LEWMGYISYSGSTTYSPSLKSRFSITRDTSKNQFFLQLNSVTPED
hu11B6_VH   LEWIGYISYSGSTTYNPSLKSRVTMSRDTSKNQFSLKLSSVTAVD
KL2B357_VH  LEWIGYISYSGSTTYNPSLKSRVTISRDTSKNQFSLKLSSVTAAD
KL2B358_VH  LEWIGYISYSGSTTYNPSLKSRVTISRDTSKNQFSLKLSSVTAAD
KL2B359_VH  LEWIGYISYSGSTTYNPSLKSRVTISRDTSKNQFSLKLSSVTAAD
KL2B360_VH  LEWIGYISYSGSTTYNPSLKSRVTISRDTSKNQFSLKLSSVTAAD
     HCF3   LEWIGYISYSGSTTYNPSLKSRVTISRDTSKNQFSLKLSSVTPVD
     HCG5   LEWMGYISYSGSTTYNPSLKSRVTISRDTSKNQFSLKLSSVTPVD
      Aln   ***:************.******.:::******** *:*.***. *

91                             117
mu11B6_VH   TATYFCATGYYYGSGFWGQGTLVTVSS
hu11B6_VH   TAVYYCATGYYYGSGFWGQGTLVTVSS
KL2B357_VH  TAVYYCATGYYYGSGFWGQGTLVTVSS
KL2B358_VH  TAVYYCATGYYYGSGFWGQGTLVTVSS
KL2B359_VH  TAVYYCATGYYYGSGFWGQGTLVTVSS
KL2B360_VH  TAVYYCATGYYYGSGFWGQGTLVTVSS
     HCF3   TAVYYCATGYYYGSGFWGQGTLVTVSS
     HCG5   TAVYYCATGYYYGSGFWGQGTLVTVSS
      Aln   **.*:**********************
```

VH consensus sequence (SEQ ID NO: 75)
QVQLQESGPGLVKPSX$_1$TLSLTCX$_2$VSGNSITSDYAWNWIRQX$_3$PGKX$_4$LEWX$_5$GYISYSGSTT
YNPSLKSRVTX$_6$SRDTSKNQFSLKLSSVTX$_7$X$_8$DTAVYYCATGYYYGSGFWGQGTLVTVSS $X_1$ is D or Q;  
$X_2$ is A or T;  
$X_3$ is P or F;  
$X_4$ is G or R;  
$X_5$ is I or M;  
$X_6$ is I or M;  
$X_7$ is A or P; or  
$X_8$ is V or A.

FIG. 2

```
              1                                                         55
mu11B6_VL    DIVLTQSPASLAVSLGQRATISCRASESVEYFGTSLMHWYRQKPGQPPKLLIYAA
hu11B6_VL    DIVLTQSPDSLAVSLGERATINCKASESVEYFGTSLMHWYQQKPGQPPKLLIYAA
KL2B357_VL   DIVLTQSPDSLAVSLGERATINCRASESVEYFGTSLMHWYQQKPGQPPKLLIYAA
KL2B358_VL   EIVLTQSPATLSLSPGERATLSCRASESVEYFGTSLMHWYQQKPGQPPKLLIYAA
KL2B359_VL   EIVLTQSPATLSLSPGERATLSCRASESVEYFGTSLMHWYQQKPGQPPRLLIYAA
KL2B360_VL   EIVLTQSPATLSLSPGERATLSCRASESVEYFGTSLMHWYQQKPGQPPRLLIYAA
      LCD6   DIVLTQSPDSLAVSLGERATINCKASESVEYFGTSLMHWYQQKPGQPPKLLIYAA
      LCB7   DIVLTQSPDSLAVSLGERATINCKASESVEYFGTSLMHWYQQKPGQPPKLLIYAA
       Aln  :*******.:*::*.*;***..*:**********************:******;******

56                                                       111
mu11B6_VL    SNVESGVPARFSGSGSGTDFSLNIQPVEEDDFSMYFCQQTRKVPYTFGGGTKLEIK
hu11B6_VL    SNRESGVPDRFSGSGSGTDFTLTISSLQAEDVAVYYCQQTRKVPYTFGQGTKLEIK
KL2B357_VL   SNVESGVPDRFSGSGSGTDFTLTISSLQAEDVAVYFCQQTRKVPYTFGGGTKVEIK
KL2B358_VL   SNVESGIPARFSGSGSGTDFTLTISSVEPEDFAVYFCQQTRKVPYTFGGGTKVEIK
KL2B359_VL   SNVESGIPARFSGSGSGTDFTLTISSVEPEDFAVYFCQQTRKVPYTFGGGTKVEIK
KL2B360_VL   SNVESGIPARFSGSGSGTDFTLTISSVEPEDFAVYFCQQTRKVPYTFGGGTKVEIK
      LCD6   SNRESGVPDRFSGSGSGTDFTLTIQSVQAEDVSVYFCQQTRKVPYTFGQGTKLEIK
      LCB7   SNRESGVPDRFSGSGSGTDFTLTISSVQAEDVAVYYCQQTRKVPYTFGQGTKLEIK
       Aln  ** ***:*.***********:*.*..::..:*.::*:***********..***:***

VL consensus sequence (SEQ ID NO: 74)
$X_1$IVLTQSP$X_2$$X_3$L$X_4$$X_5$S$X_6$GERAT$X_7$$X_8$C$X_9$ASESVEYFGTSLMHWYQQKPGQPP$X_{10}$LLIYAASN$X_{11}$
ESG$X_{12}$P$X_{13}$RFSGSGSGTDFTLTI$X_{14}$S$X_{15}$$X_{16}$Q$X_{17}$ED$X_{18}$$X_{19}$VY$X_{20}$CQQTRKVPYTFG$X_{21}$GTK$X_{22}$EIK
```

$X_1$ is D or E;       $X_2$ is D or A;       $X_3$ is S or T;       $X_4$ is A or S;
$X_5$ is V or L;       $X_6$ is L or P;       $X_7$ is I or L;       $X_8$ is N or S;
$X_9$ is R or K;       $X_{10}$ is K or R;    $X_{11}$ is V or R;    $X_{12}$ is V or I;
$X_{13}$ is A or D;    $X_{14}$ is Q or S;    $X_{15}$ is L or V;    $X_{16}$ is Q or E;
$X_{17}$ is P or A;    $X_{18}$ is F or V;    $X_{19}$ is A or S;    $X_{20}$ is Y or F;
$X_{21}$ is Q or G;    and $X_{22}$ is L or V.

FIG. 3

```
             1                                                    50
h11B6        VPLIEGRIVGGWECEKHSQPWQVAVYSHGWAHCGGVLVHPQWVLTAAHCL
KL2B494      VPLIEGRIVGGWECEKHSQPWQVAVYSHGWAHCGGVLVHPQWVLTAAHCL
KL2B467      VPLIEGRIVGGWECEKHSQPWQVAVYSHGWAHCGGVLVHPQWVLTAAHCL
KL2B30       VPLIEGRIVGGWECEKHSQPWQVAVYSHGWAHCGGVLVHPQWVLTAAHCL
KL2B413      VPLIEGRIVGGWECEKHSQPWQVAVYSHGWAHCGGVLVHPQWVLTAAHCL
KL2B53       VPLIEGRIVGGWECEKHSQPWQVAVYSHGWAHCGGVLVHPQWVLTAAHCL 51                                                   100
h11B6        KKNSQVWLGRHNLFEPEDTGQRVPVSHSFPHPLYNMSLLKHQSLRPDEDS
KL2B494      KKNSQVWLGRHNLFEPEDTGQRVPVSHSFPHPLYNMSLLKHQSLRPDEDS
KL2B467      KKNSQVWLGRHNLFEPEDTGQRVPVSHSFPHPLYNMSLLKHQSLRPDEDS
KL2B30       KKNSQVWLGRHNLFEPEDTGQRVPVSHSFPHPLYNMSLLKHQSLRPDEDS
KL2B413      KKNSQVWLGRHNLFEPEDTGQRVPVSHSFPHPLYNMSLLKHQSLRPDEDS
KL2B53       KKNSQVWLGRHNLFEPEDTGQRVPVSHSFPHPLYNMSLLKHQSLRPDEDS 101                                                  150
h11B6        SHDLMLLRLSEPAKITDVVKVLGLPTQEPALGTTCYASGWGSIEPEEFLR
KL2B494      SHDLMLLRLSEPAKITDVVKVLGLPTQEPALGTTCYASGWGSIEPEEFLR
KL2B467      SHDLMLLRLSEPAKITDVVKVLGLPTQEPALGTTCYASGWGSIEPEEFLR
KL2B30       SHDLMLLRLSEPAKITDVVKVLGLPTQEPALGTTCYASGWGSIEPEEFLR
KL2B413      SHDLMLLRLSEPAKITDVVKVLGLPTQEPALGTTCYASGWGSIEPEEFLR
KL2B53       SHDLMLLRLSEPAKITDVVKVLGLPTQEPALGTTCYASGWGSIEPEEFLR 151                                                  200
h11B6        PRSLQCVSLHLLSNDMCARAYSEKVTEFMLCAGLWTGGKDTCGGDSGGPL
KL2B494      PRSLQCVSLHLLSNDMCARAYSEKVTEFMLCAGLWTGGKDTCGGDSGGPL
KL2B467      PRSLQCVSLHLLSNDMCARAYSEKVTEFMLCAGLWTGGKDTCGGDSGGPL
KL2B30       PRSLQCVSLHLLSNDMCARAYSEKVTEFMLCAGLWTGGKDTCGGDSGGPL
KL2B413      PRSLQCVSLHLLSNDMCARAYSEKVTEFMLCAGLWTGGKDTCGGDSGGPL
KL2B53       PRSLQCVSLHLLSNDMCARAYSEKVTEFMLCAGLWTGGKDTCGGDSGGPL 201                                         244
H11B6        VCNGVLQGITSWGPEPCALPEKPAVYTKVVHYRKWIKDTIAANP
KL2B494      VCNGVLQGITSWGPEPCALPEKPAVYTKVVHYRKWIKDTIAANP
KL2B467      VCNGVLQGITSWGPEPCALPEKPAVYTKVVHYRKWIKDTIAANP
KL2B30       VCNGVLQGITSWGPEPCALPEKPAVYTKVVHYRKWIKDTIAANP
KL2B413      VCNGVLQGITSWGPEPCALPEKPAVYTKVVHYRKWIKDTIAANP
KL2B53       VCNGVLQGITSWGPEPCALPEKPAVYTKVVHYRKWIKDTIAANP
```

FIG. 6

```
              1                                                       54
CD3B815_VL    DILLTQSPGILSVSPGERVSFSCRARQSIGTAIHWYQQRTNGSPRLLIKYASES
CD3W244_VL    DIQMTQSPSSLSASVGDRVTITCRARQSIGTAIHWYQQKPGKAPKLLIYYASES
CD3W245_VL    DIQMTQSPSSLSASVGDRVTITCRARQSIGTAIHWYQQKPGKAPKLLIKYASES
CD3W246_VL    DIQMTQSPSSLSASVGDRVTITCRARQSIGTAIHWYQQKPGKAPKLLIKYASES
CD3W247_VL    DIQMTQSPSSLSASVGDRVTITCRARQSIGTAIHWYQQKPGKAPKLLIYYASES
CD3W248_VL    DILLTQSPGILSVSPGERVSFSCRARQSIGTAIHWYQQRTNGSPRLLIKYASES
Aln           ***:****::**:*:*;**::*******************:::*;***:*****

55                                                     107
CD3B815_VL    ISGIPSRFSGSGSGTDFTLTINSVESEDIADYYCQQSNSWPYTFGGGTKLEIK
CD3W244_VL    ISGVPSRFSGSGSGTDFTLTISSVQPEDFATYYCQQSGSWPYTFGQGTKLEIK
CD3W245_VL    ISGVPSRFSGSGSGTDFTLTISSLQPEDFATYYCQQSGSWPYTFGQGTKLEIK
CD3W246_VL    ISGVPSRFSGSGSGTDFTLTISSVQPEDFATYYCQQSGSWPYTFGQGTKLEIK
CD3W247_VL    ISGVPSRFSGSGSGTDFTLTISSLQPEDFATYYCQQSGSWPYTFGQGTKLEIK
CD3W248_VL    ISGIPSRFSGSGSGTDFTLTINSVESEDIADYYCQQSGSWPYTFGGGTKLEIK
Aln           ***:****************:*:*:**:*:******:******:*******
```

VL consensus sequence (SEQ ID NO: genus:157)
DIQX$_1$TQSPX$_2$X$_3$LSX$_4$SX$_5$GX$_6$RVX$_7$X$_8$X$_9$CRARQSIGTAIHWYQQKX$_{10}$X$_{11}$X$_{12}$X$_{13}$PX$_{14}$LLIX$_{15}$YAS
ESISGX$_{16}$PSRFSGSGSGTDFTLTIX$_{17}$SX$_{18}$QX$_{19}$EDX$_{20}$AX$_{21}$YYCQQSX$_{22}$SWPYTFGX$_{23}$GTKLEIK wherein
$X_1$ is L or M;  $X_2$ is G or S;  $X_3$ is I or S;
$X_4$ is V or A;  $X_5$ is P or V;  $X_6$ is E or D;
$X_7$ is S or T;  $X_8$ is F or I;  $X_9$ is S or T;
$X_{10}$ is T or P;  $X_{11}$ is N or G;  $X_{12}$ is G or K;
$X_{13}$ is S or A;  $X_{14}$ is R or K;  $X_{15}$ is K or Y;
$X_{16}$ is I or V;  $X_{17}$ is N or S;  $X_{18}$ is V or L;
$X_{19}$ is S or P;  $X_{20}$ is I or F;  $X_{21}$ is D or T;
$X_{22}$ is N or G; or  $X_{23}$ is G or Q.

FIG. 19(contd)
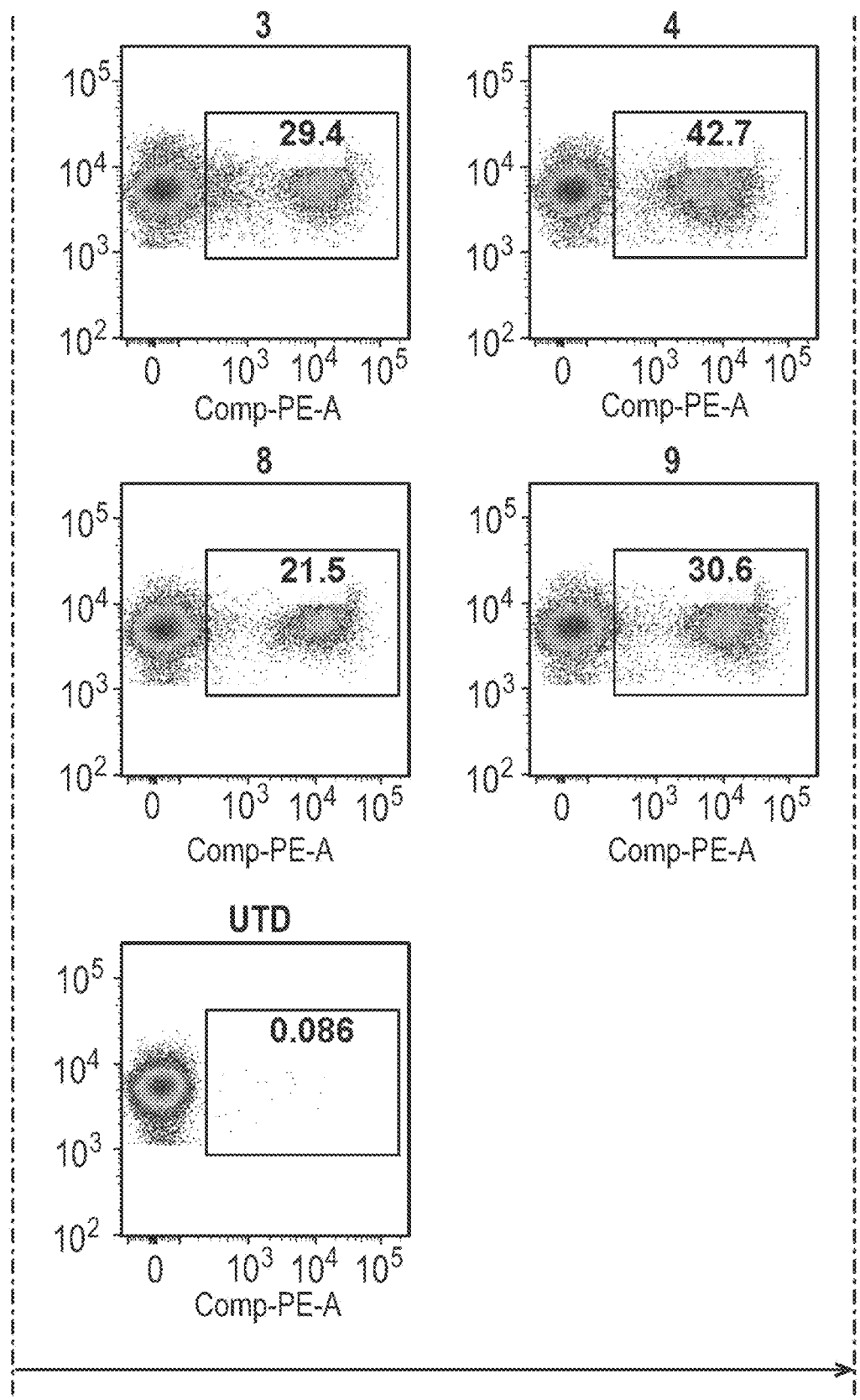

FIG. 19(contd)
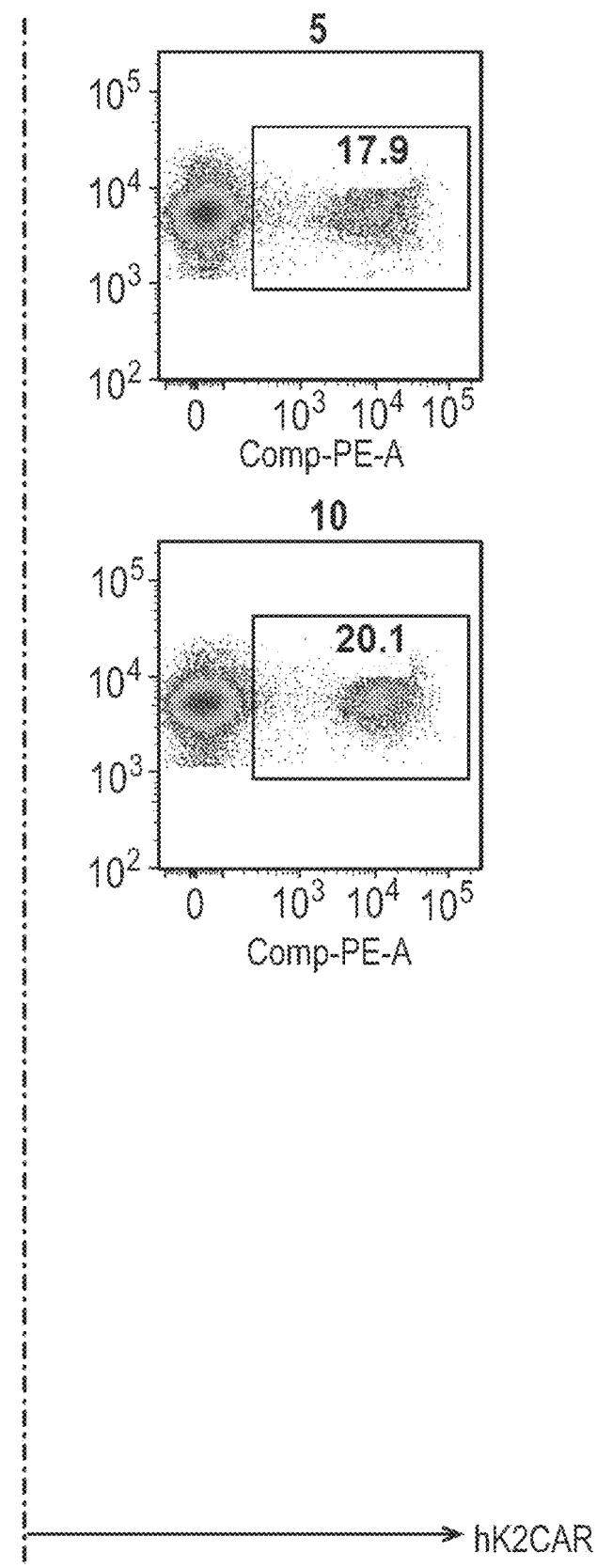

FIG. 22
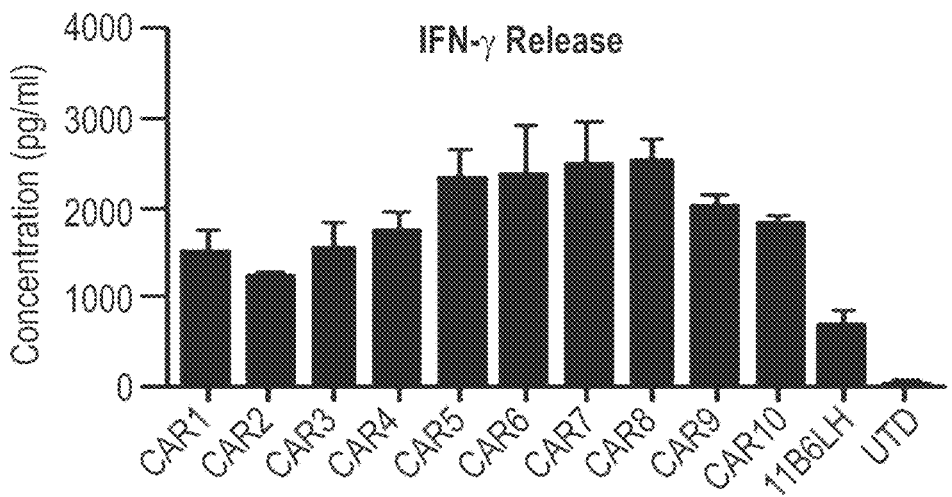
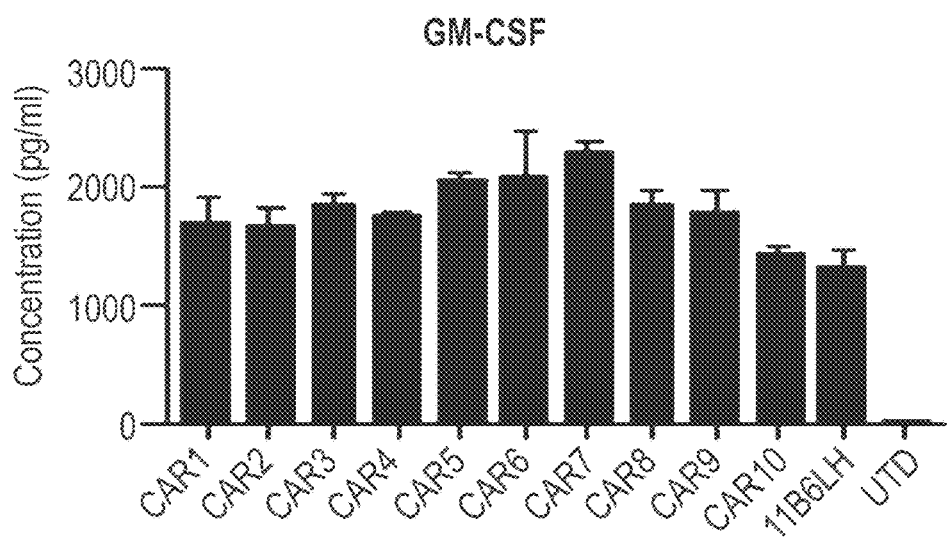
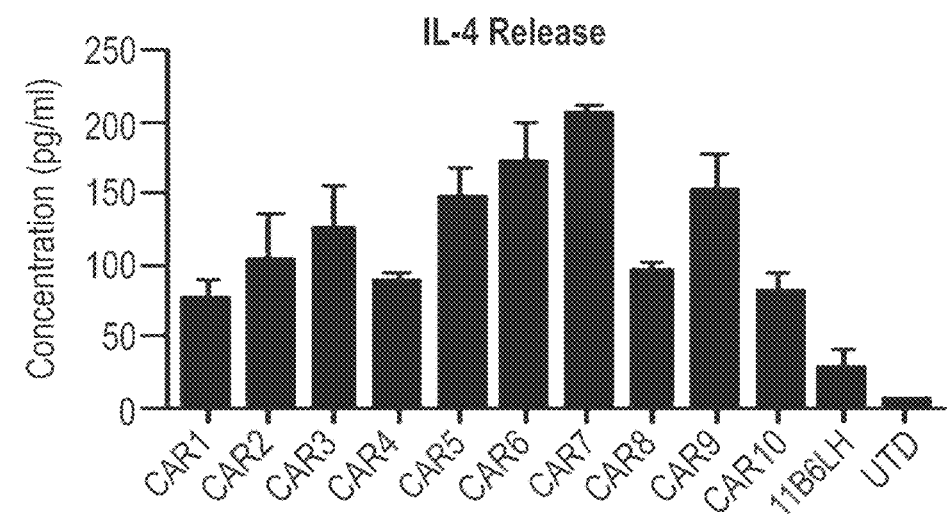

FIG. 22 (contd)
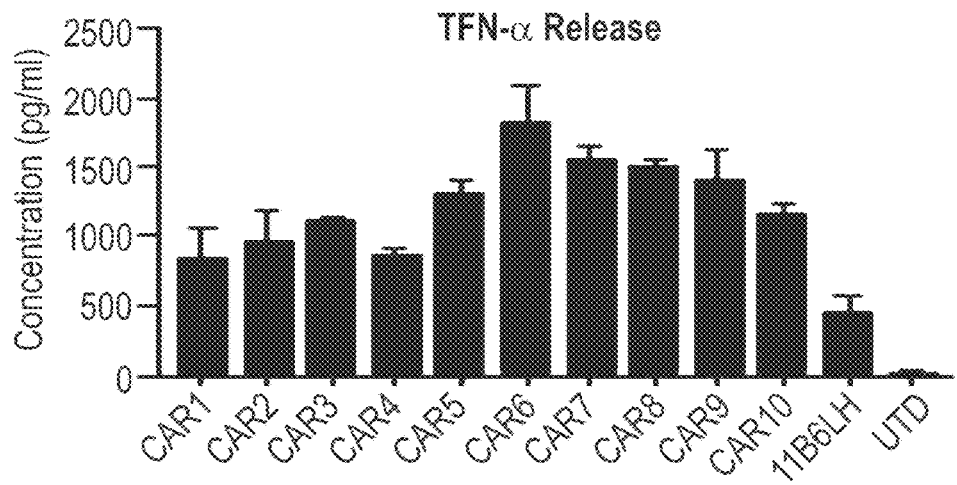
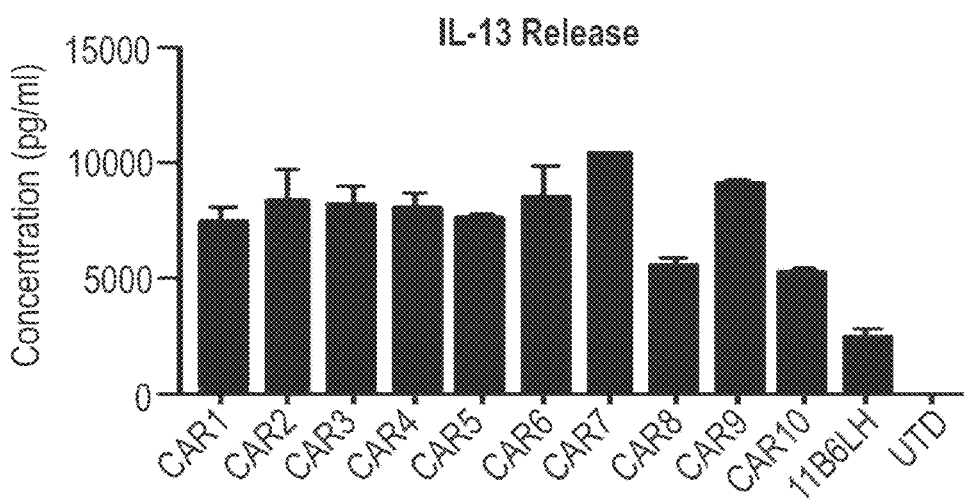
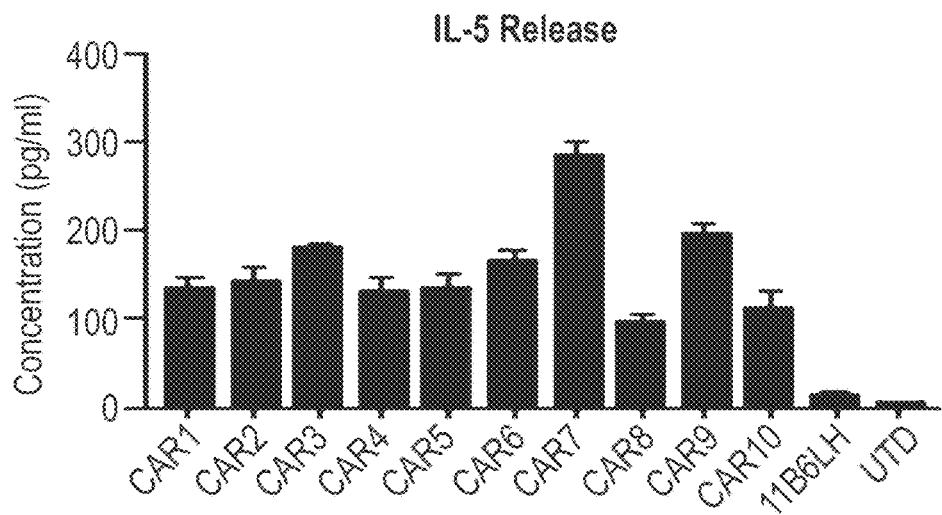

FIG. 22 (contd)
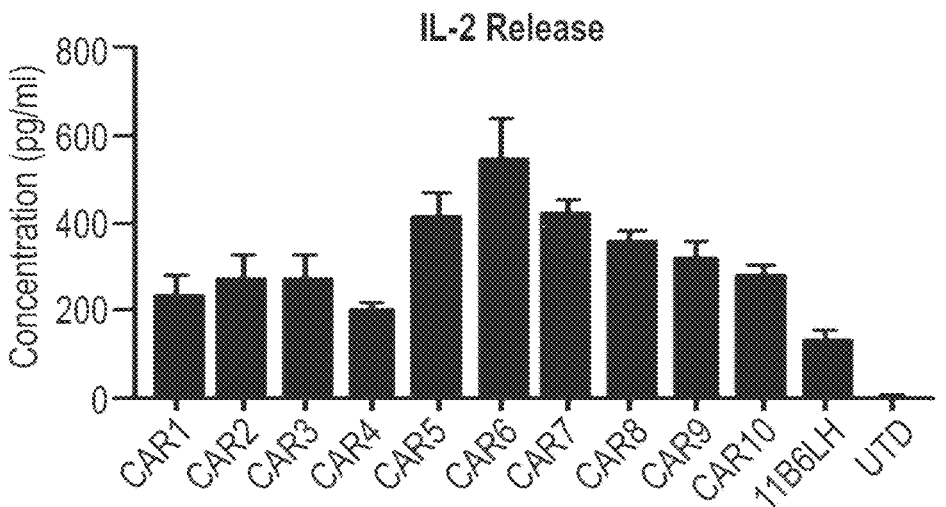
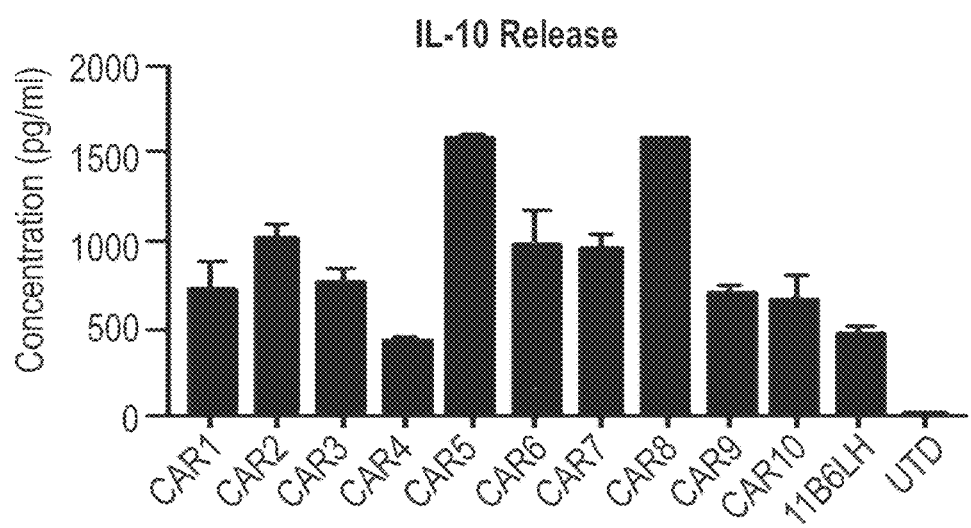
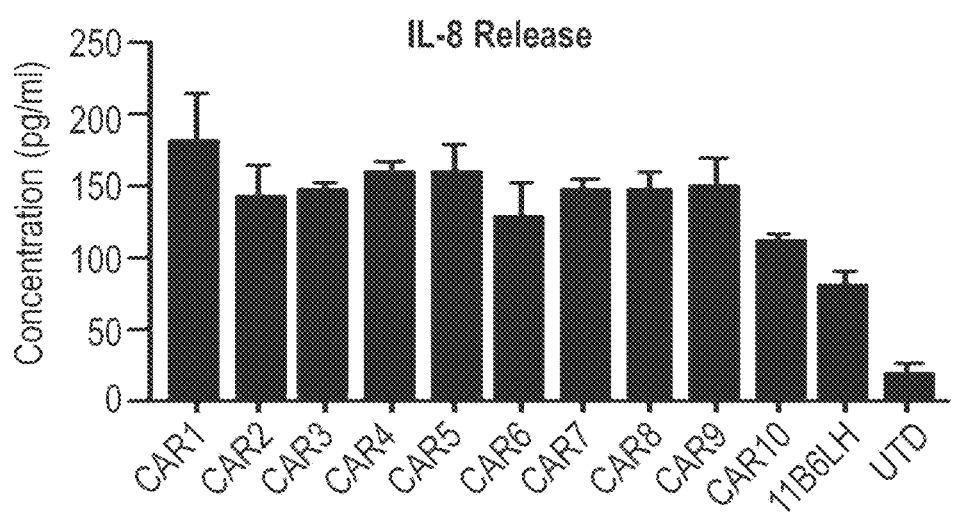

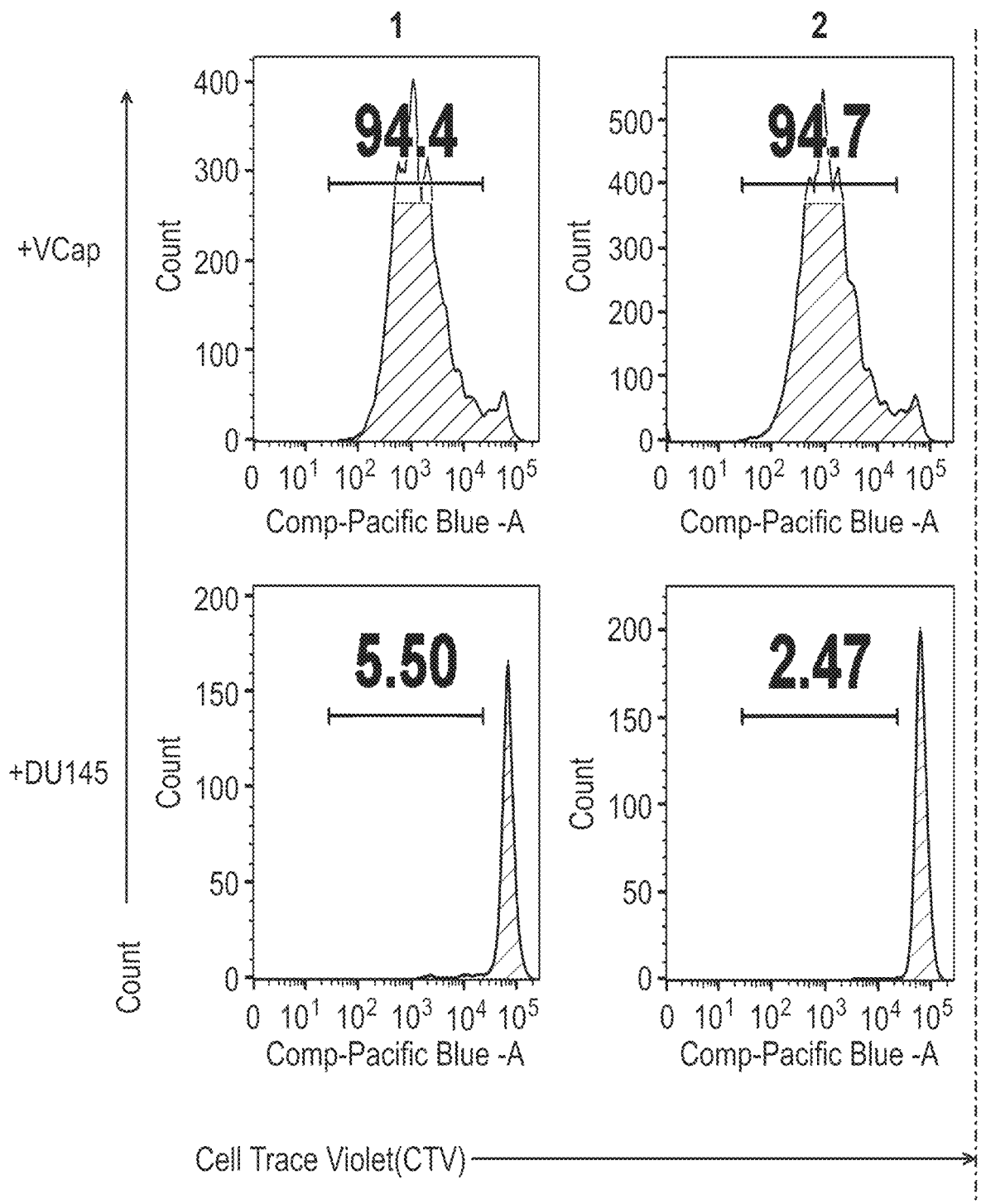

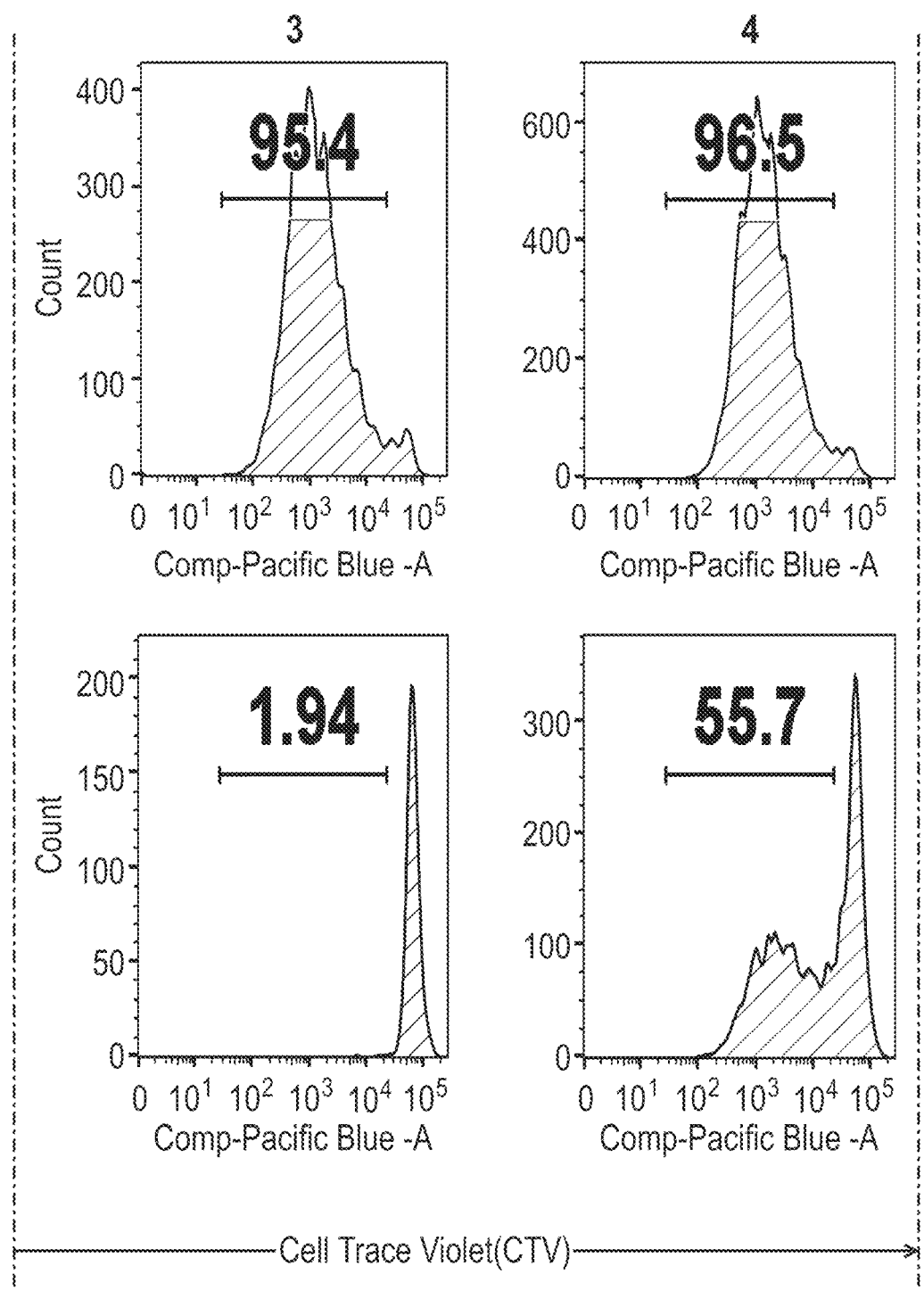
FIG. 24A(contd)

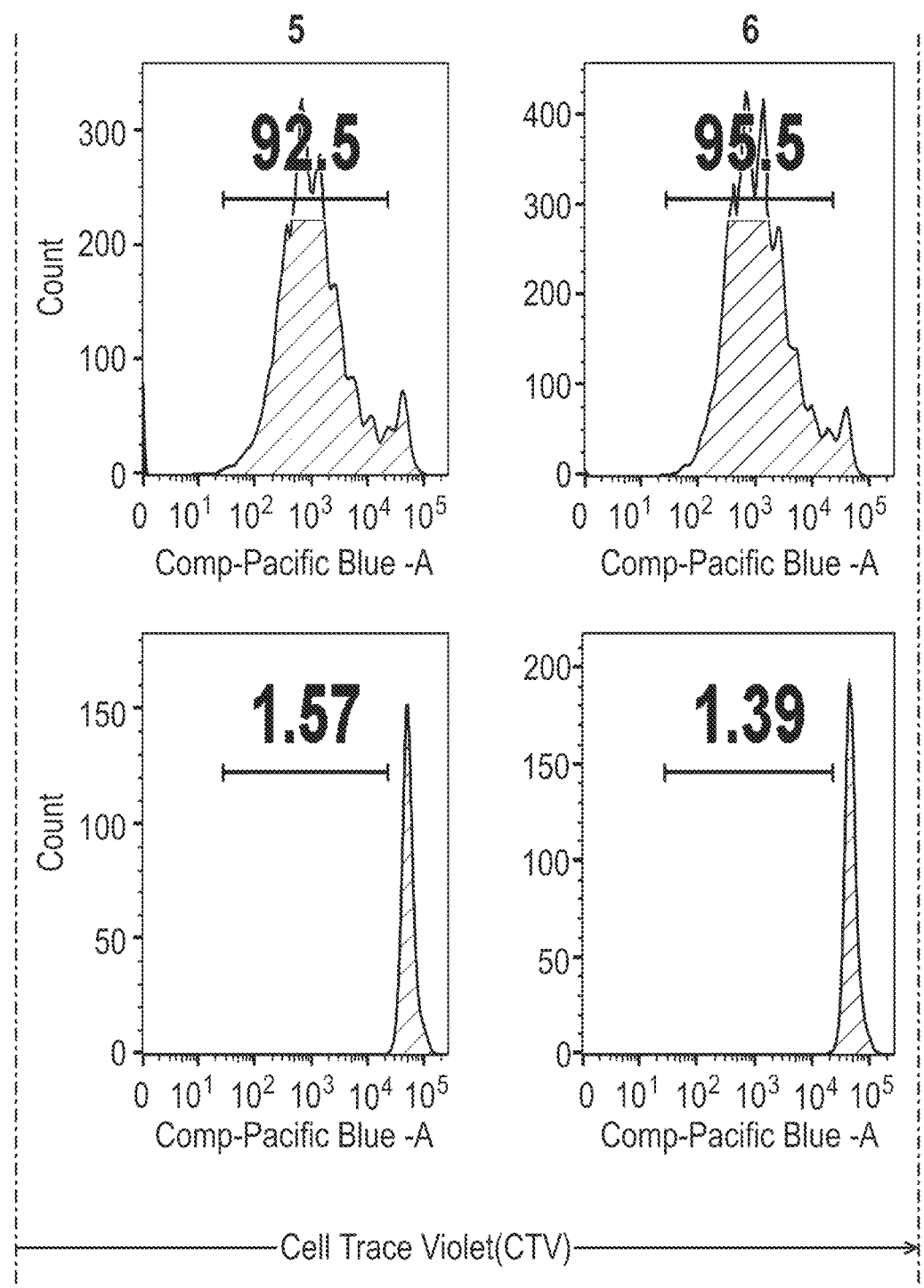
FIG. 24A(contd)

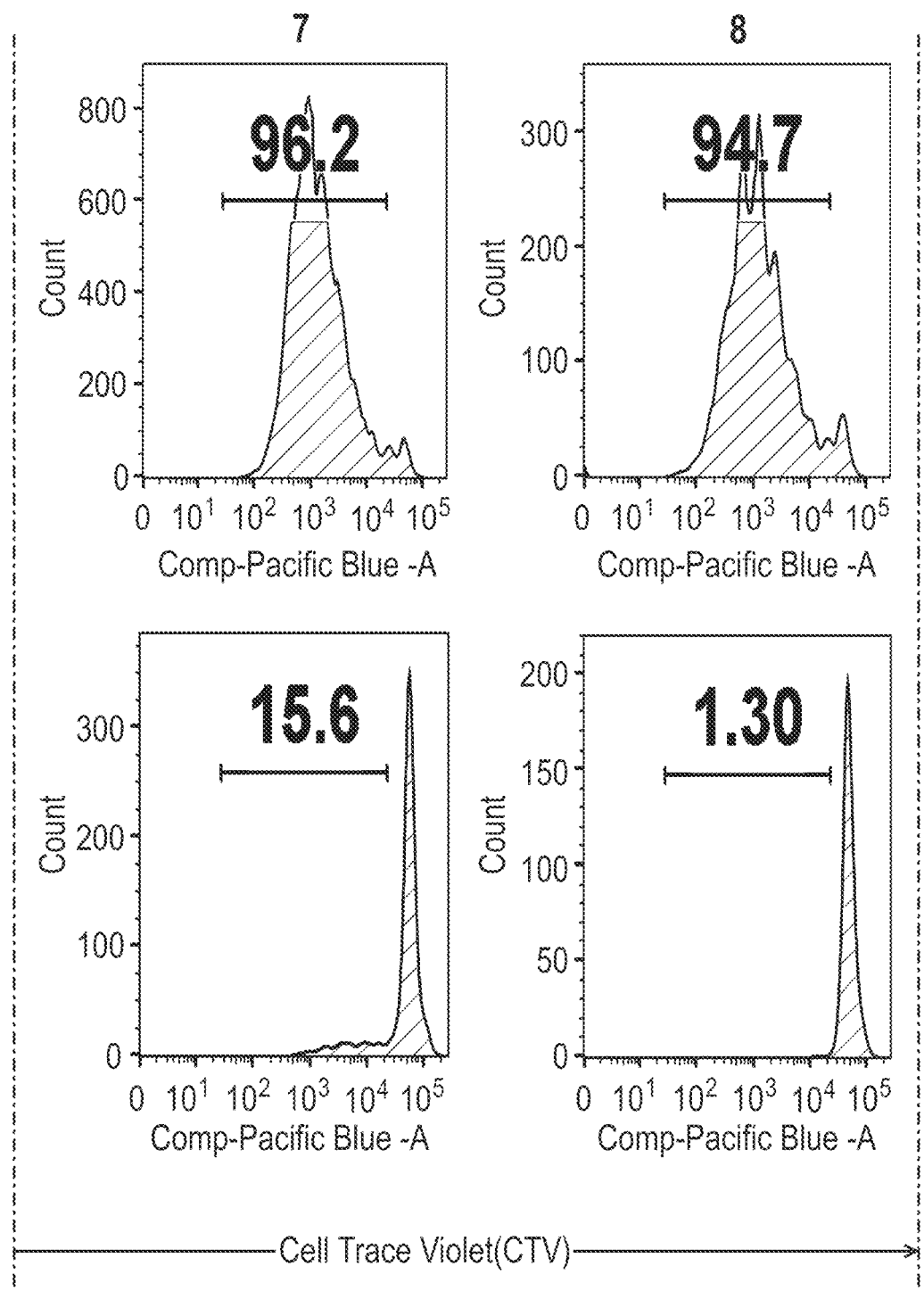
FIG. 24A(contd)

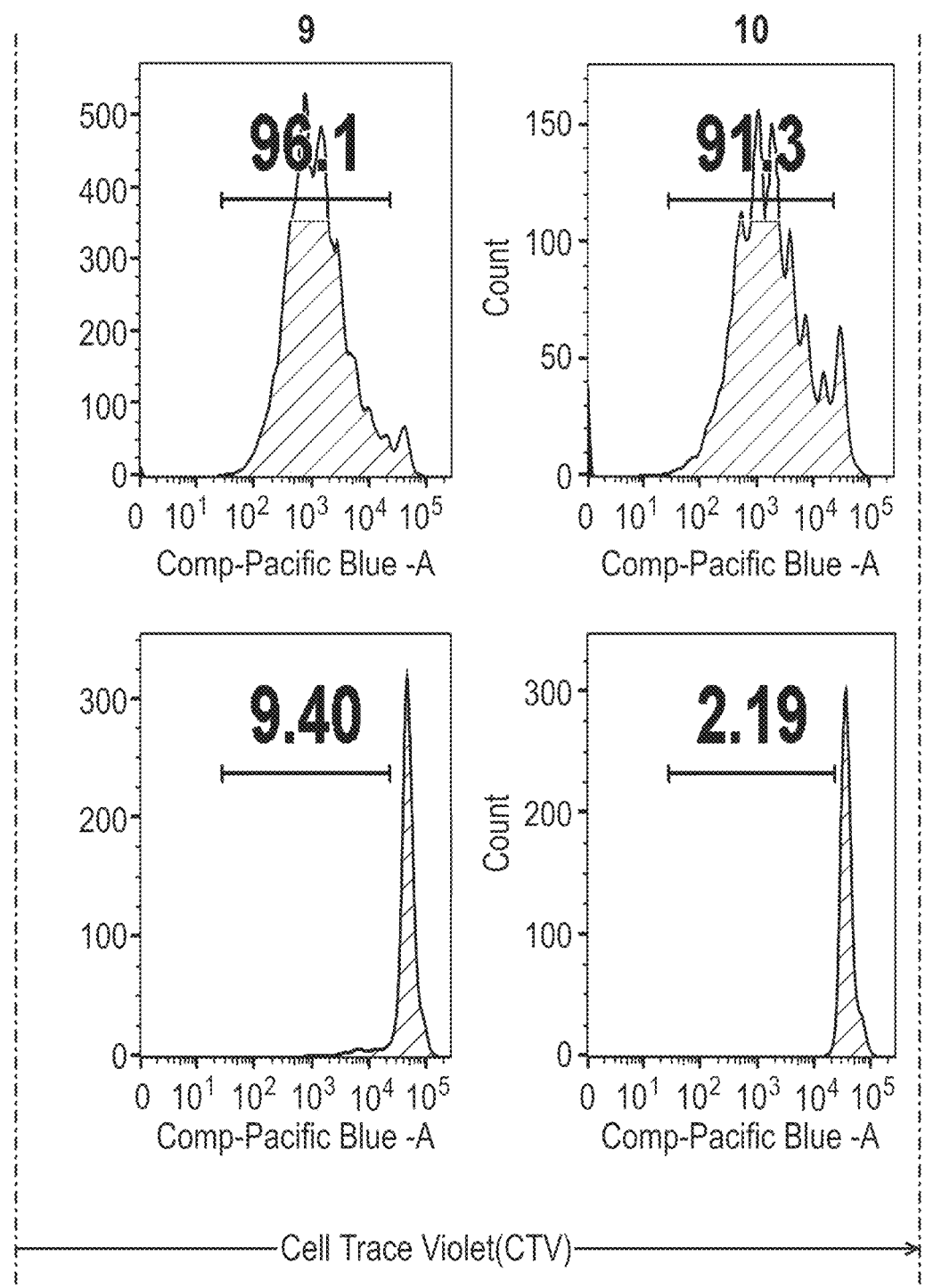
FIG. 24A(contd)

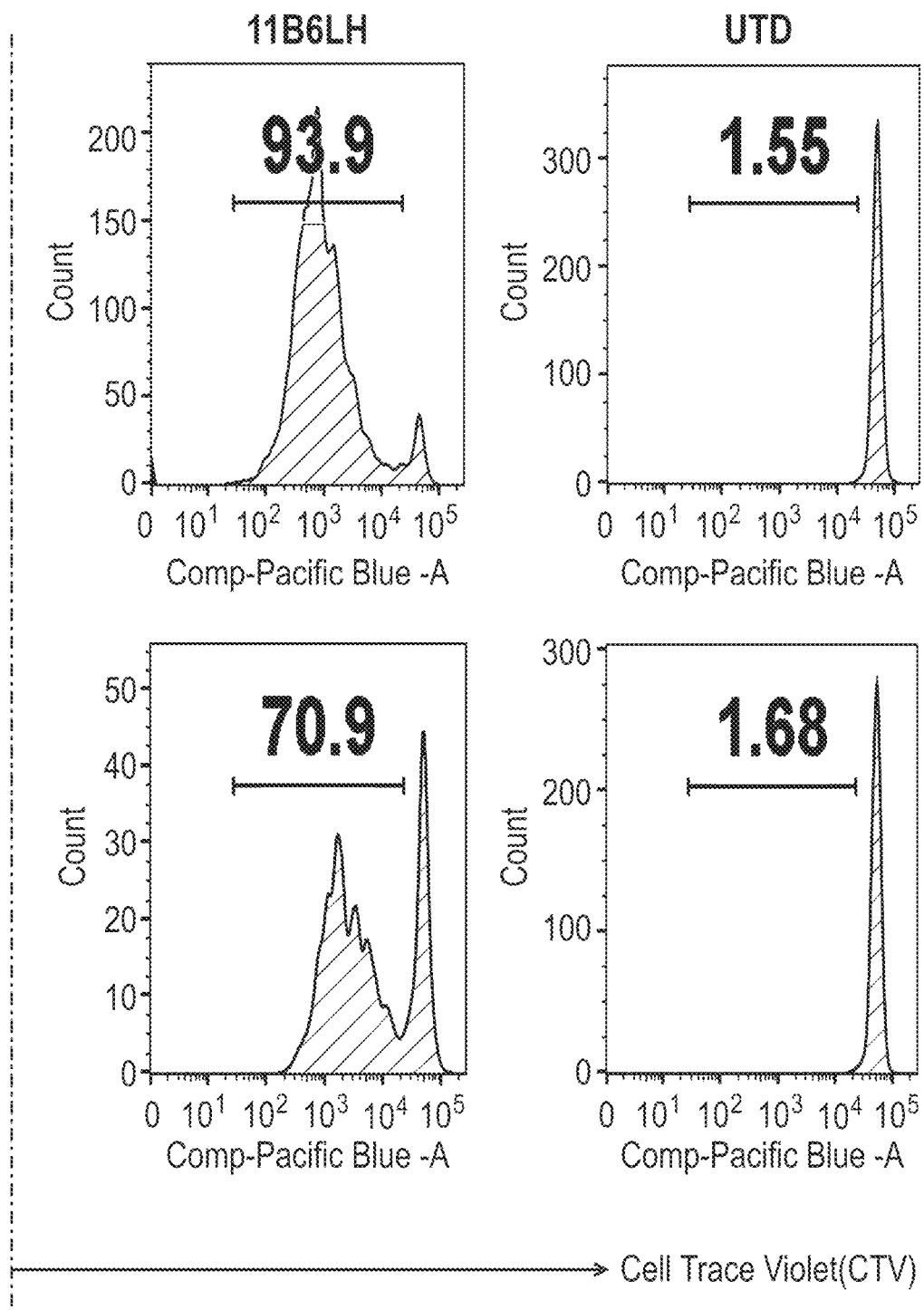
FIG. 24A(contd)

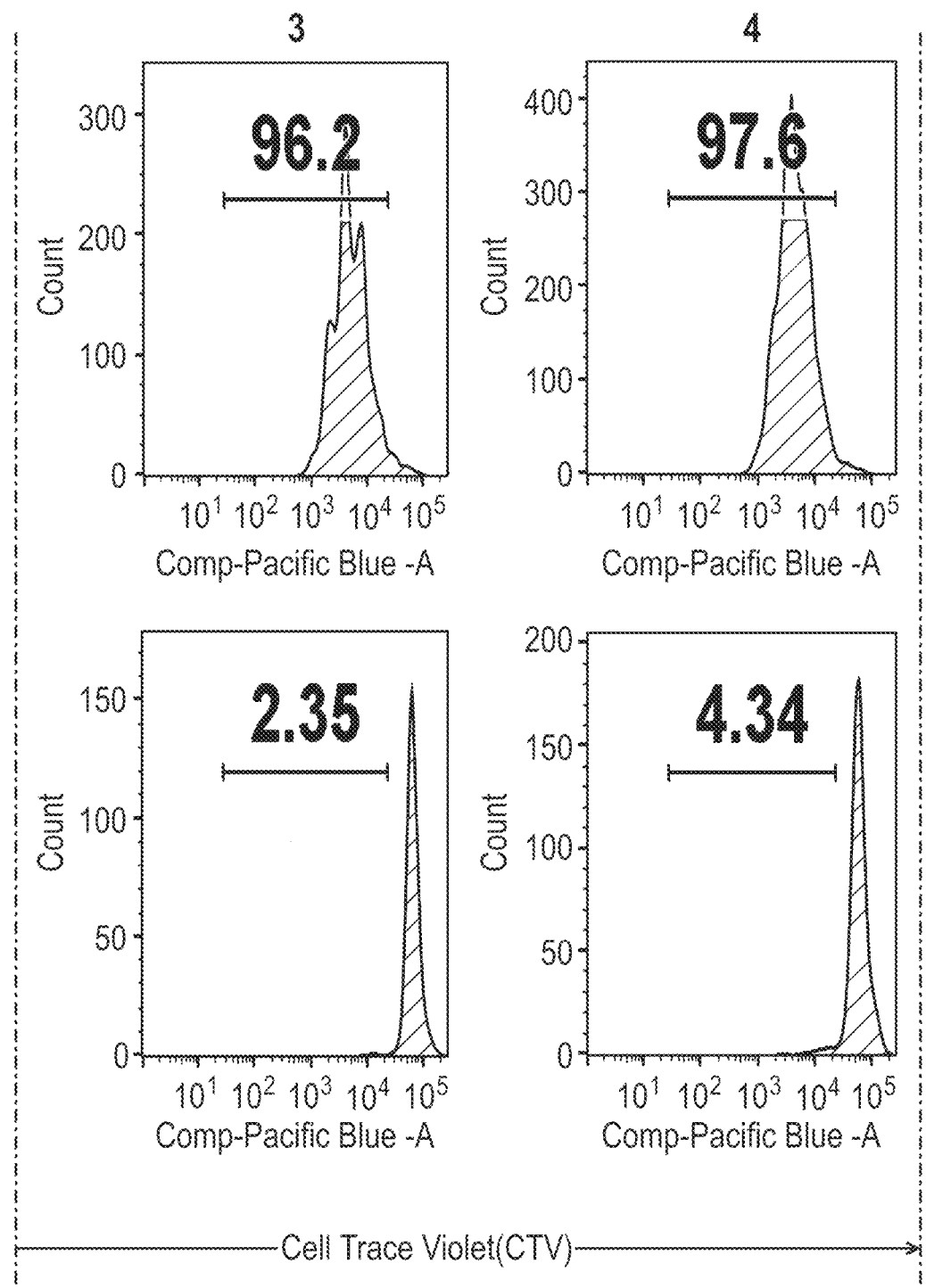

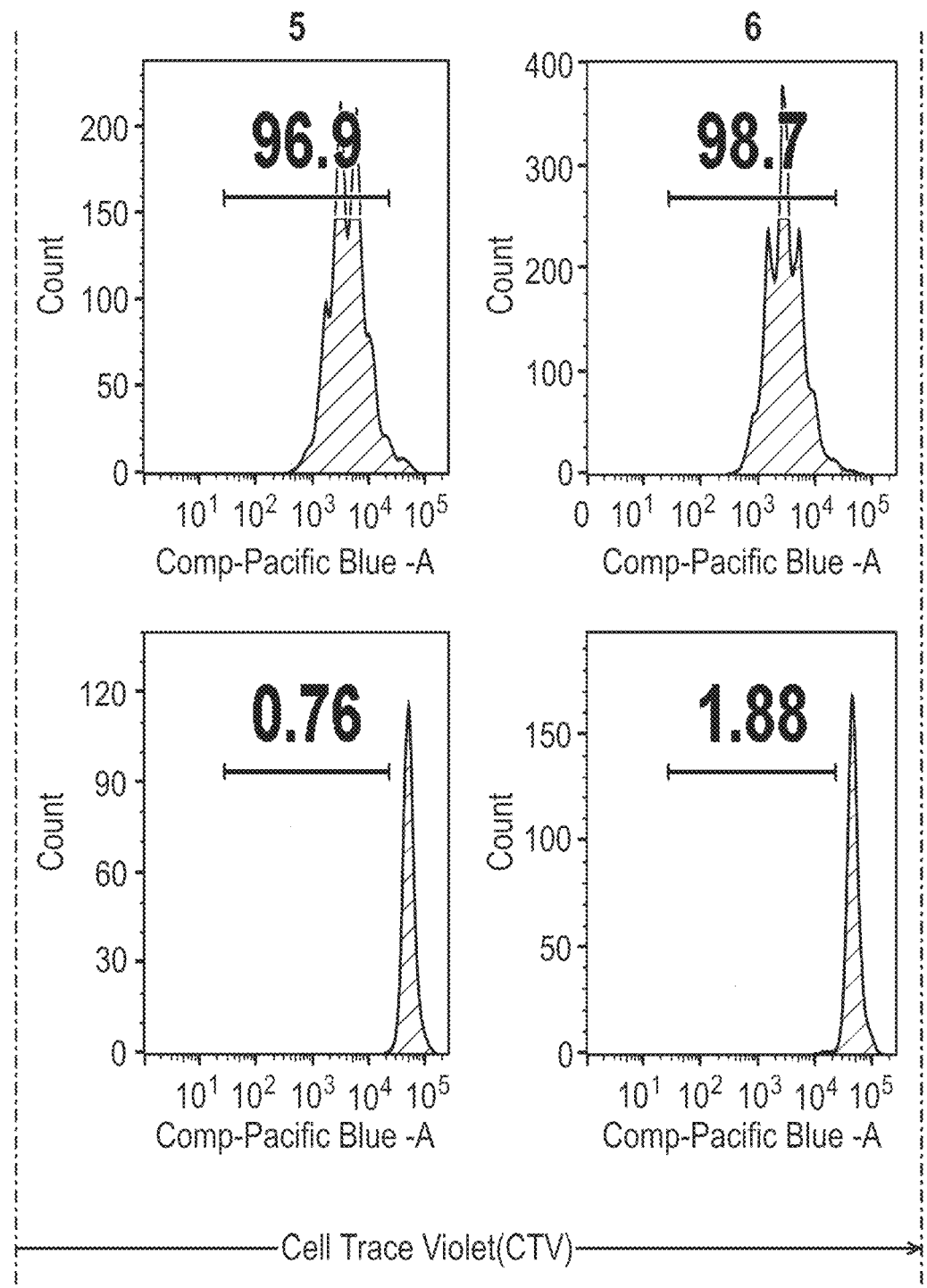

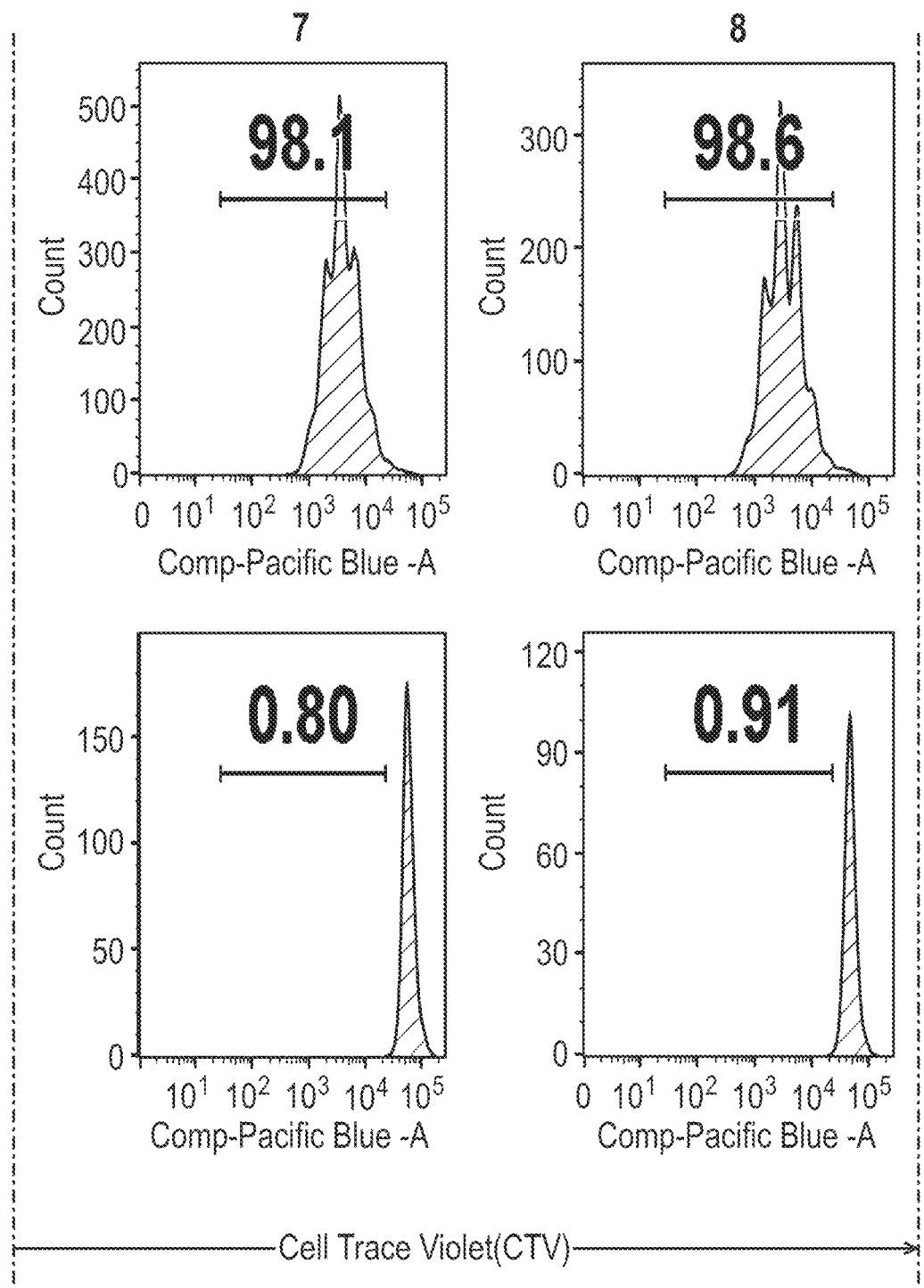

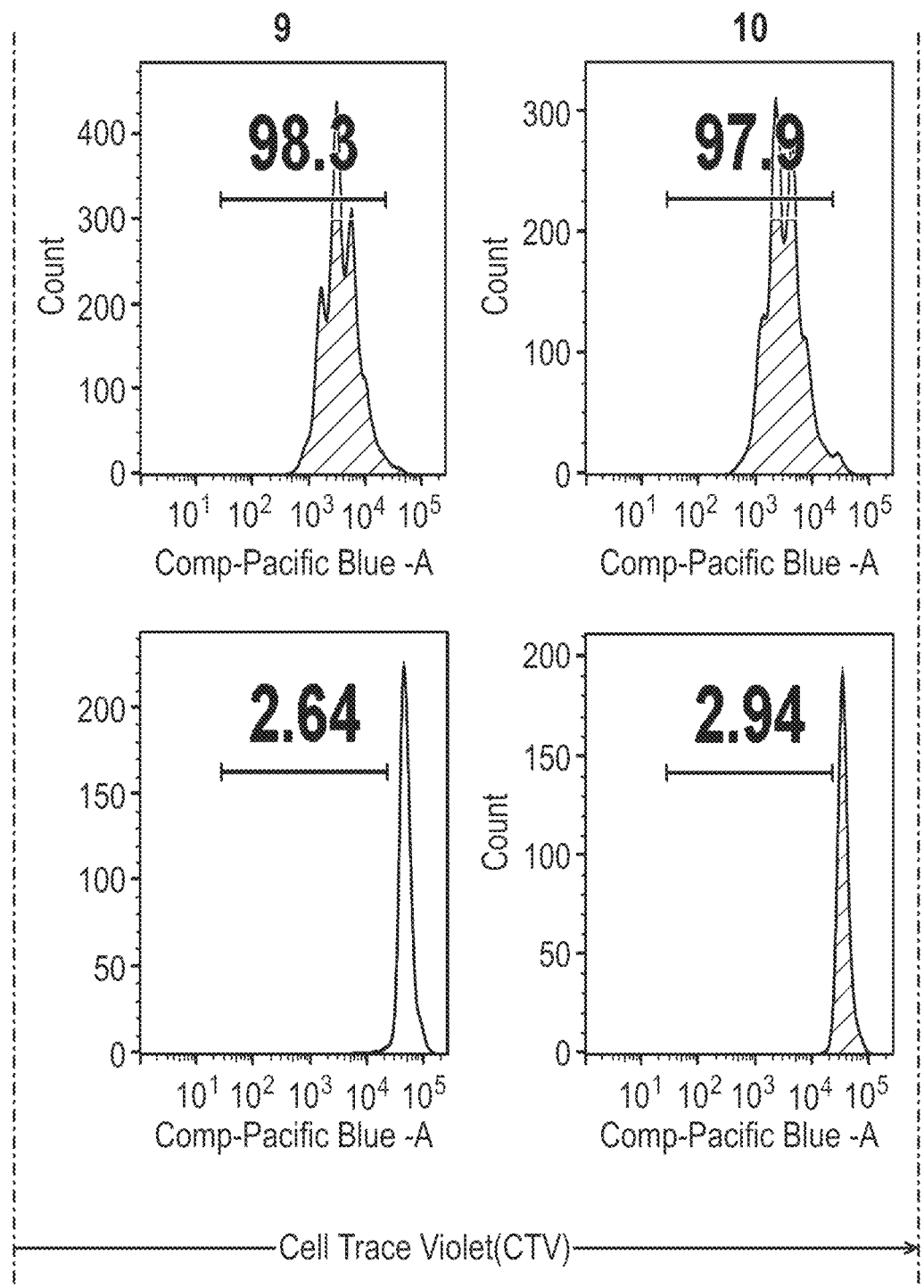

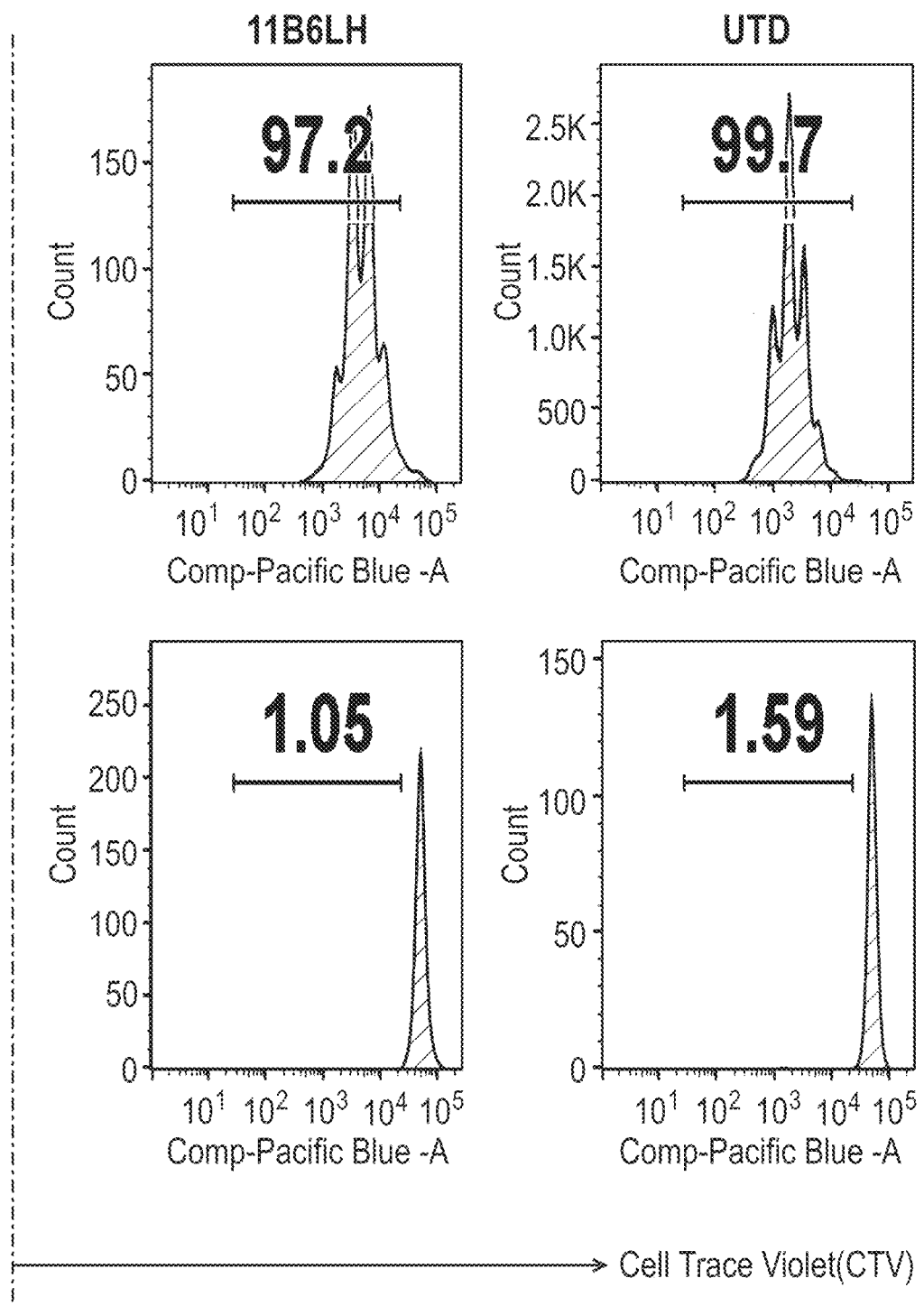

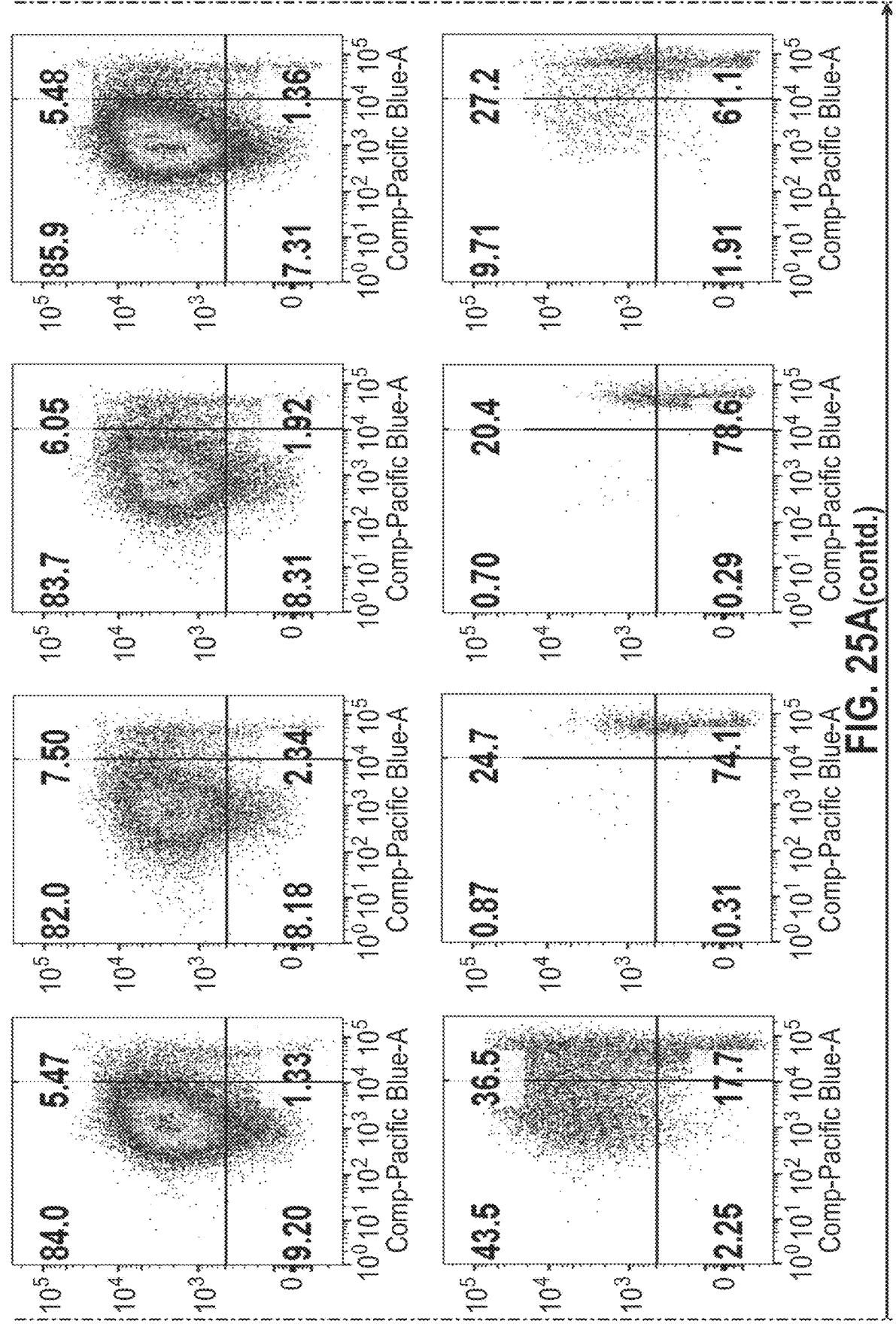
FIG. 25A (contd.)

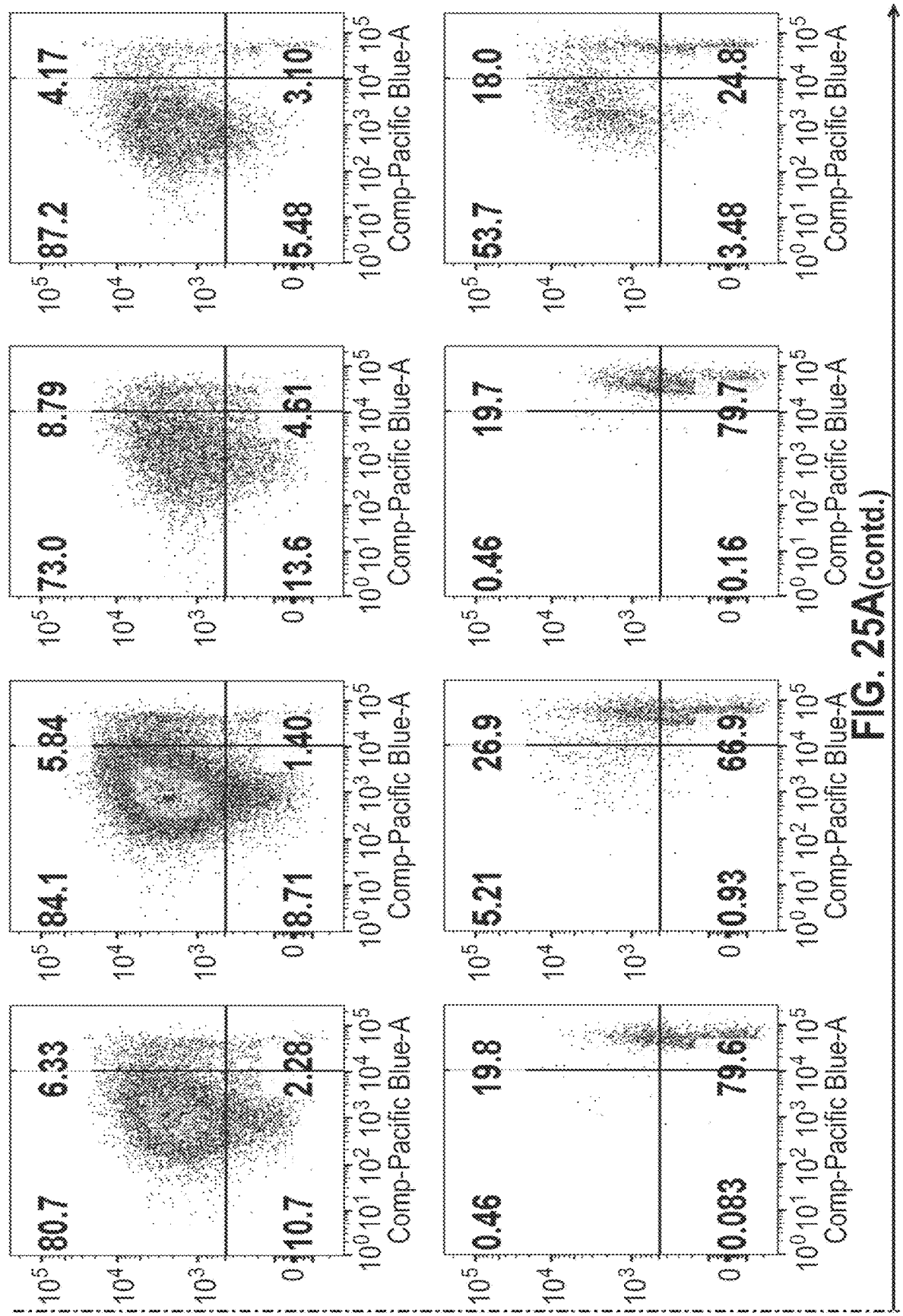
FIG. 25A(contd.)

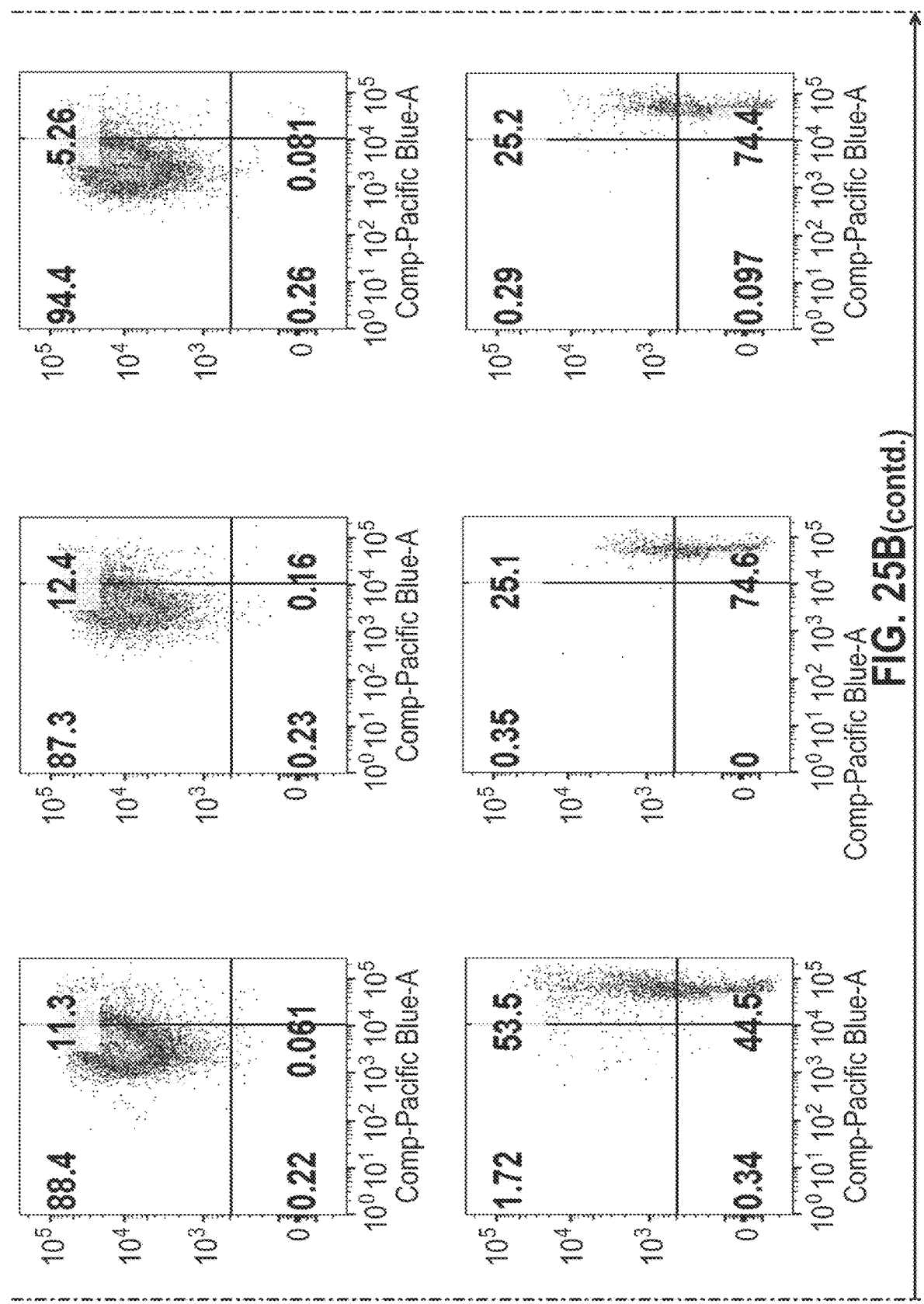
FIG. 25B(contd.)

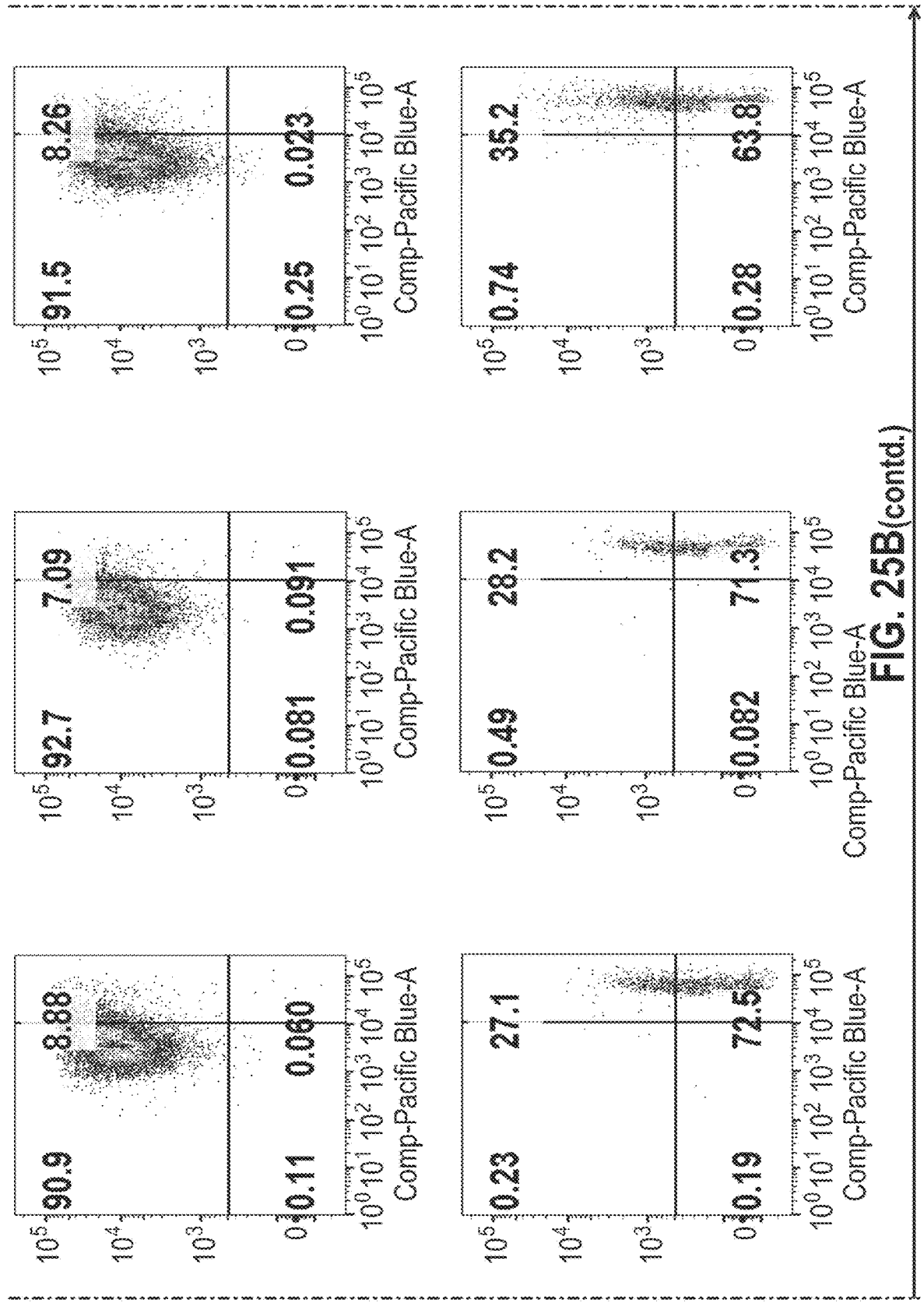
FIG. 25B(contd.)

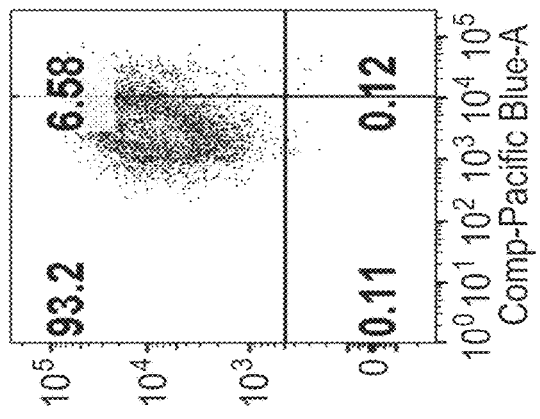
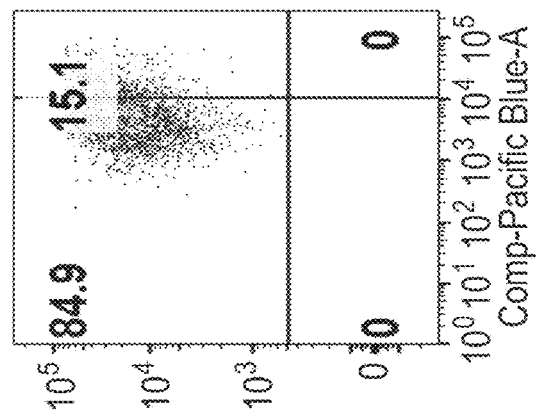
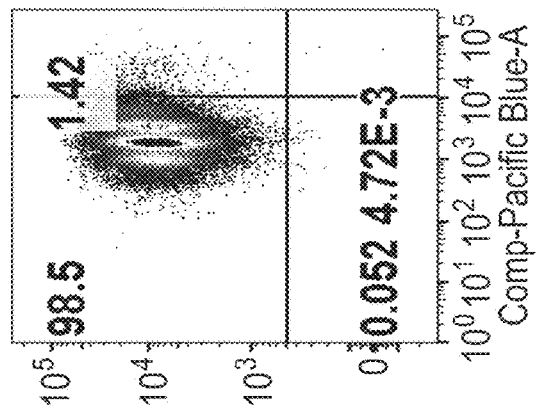
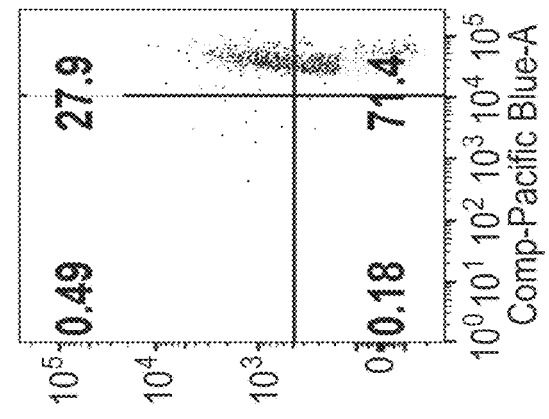
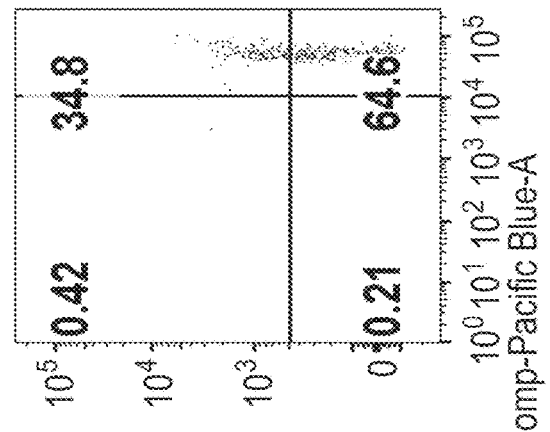
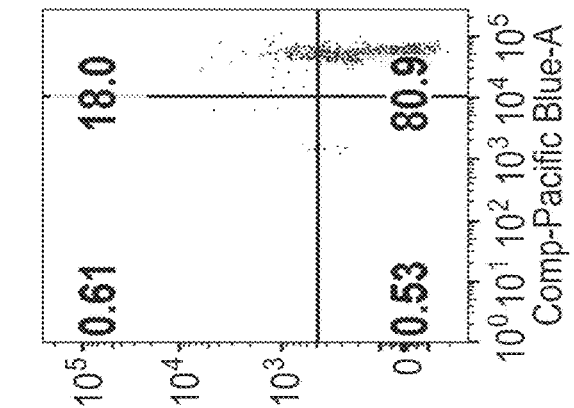
FIG. 25B (contd.)

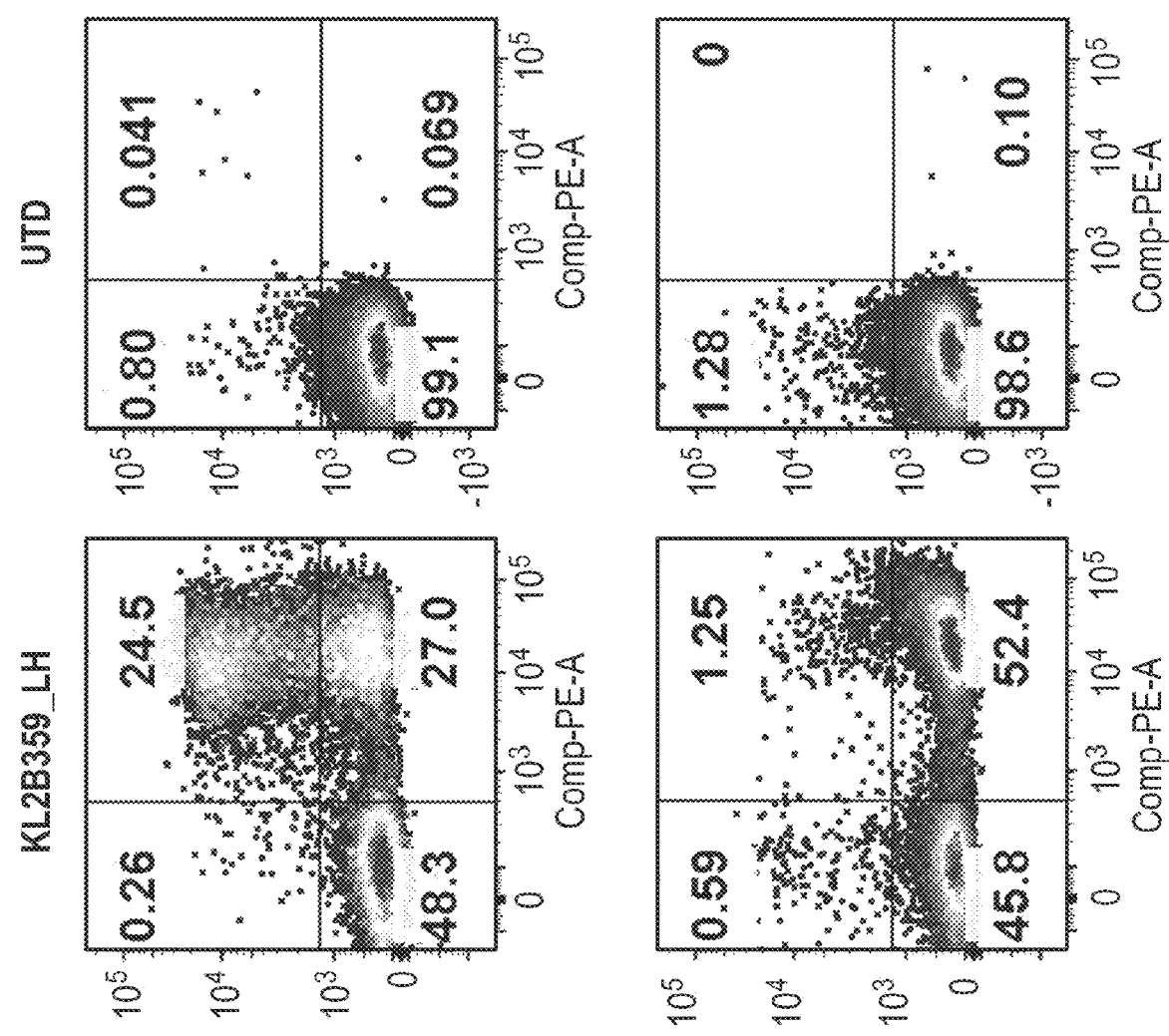
FIG. 33A(contd)

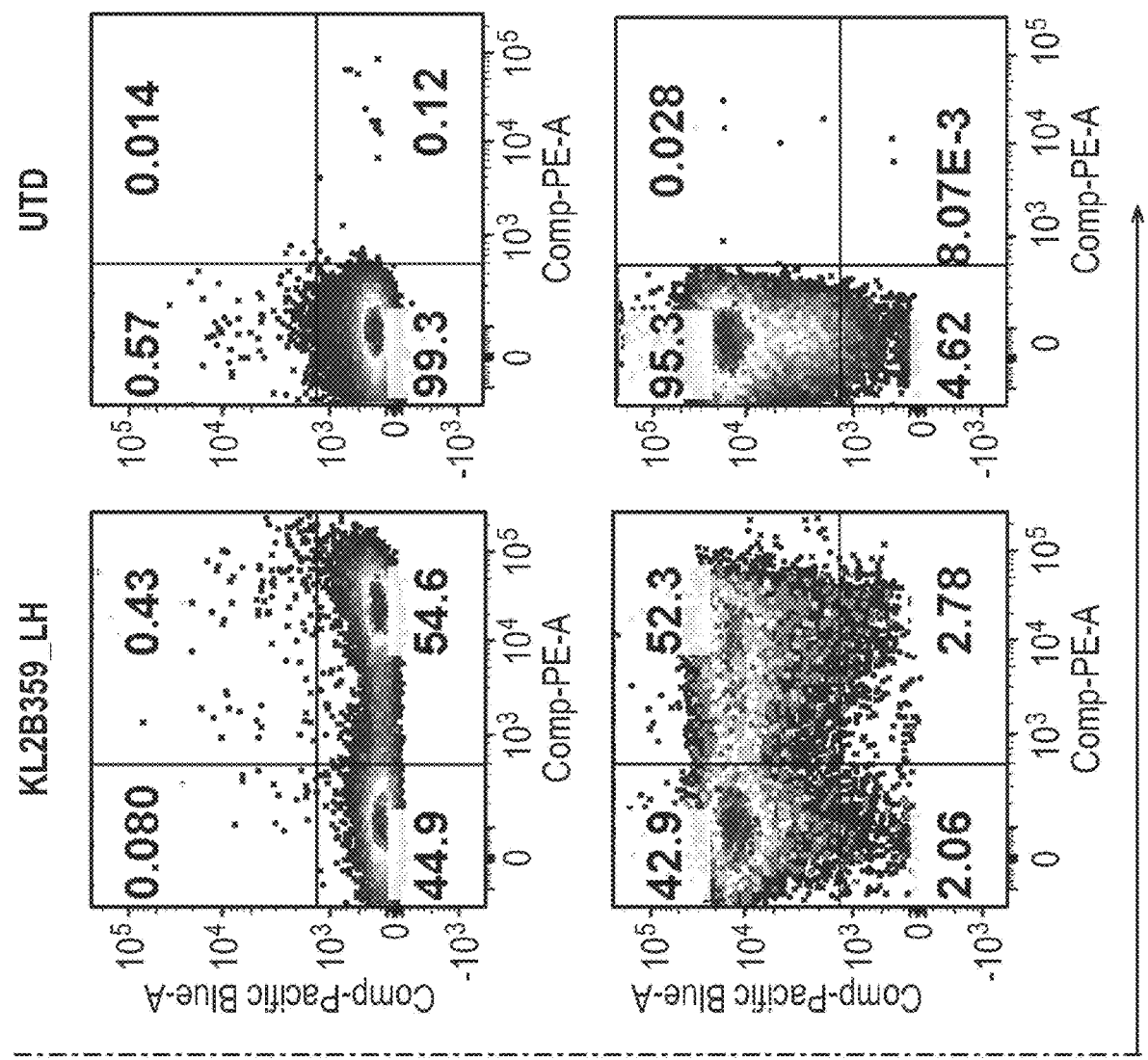
FIG. 33B(contd)

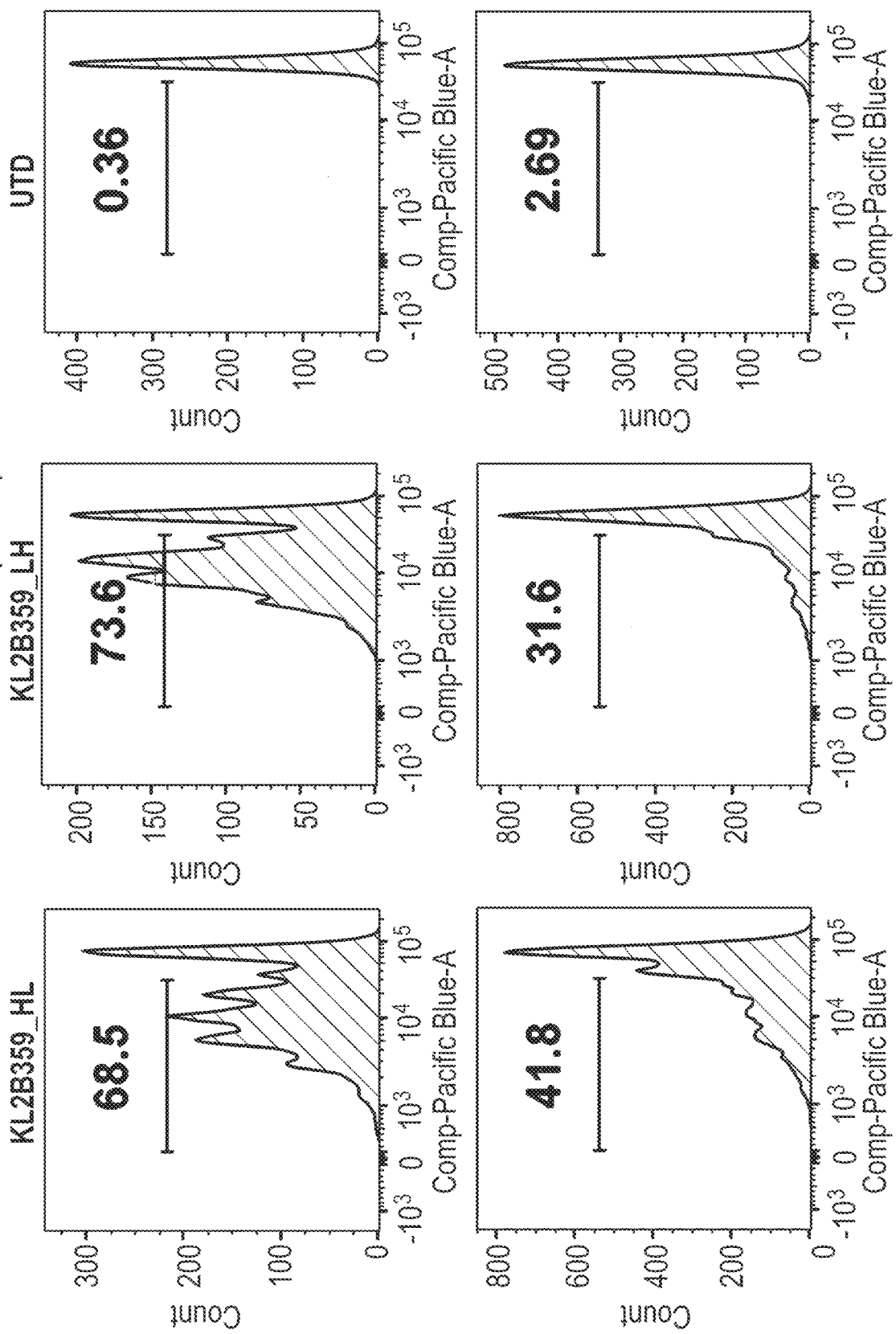
FIG. 34A(contd)

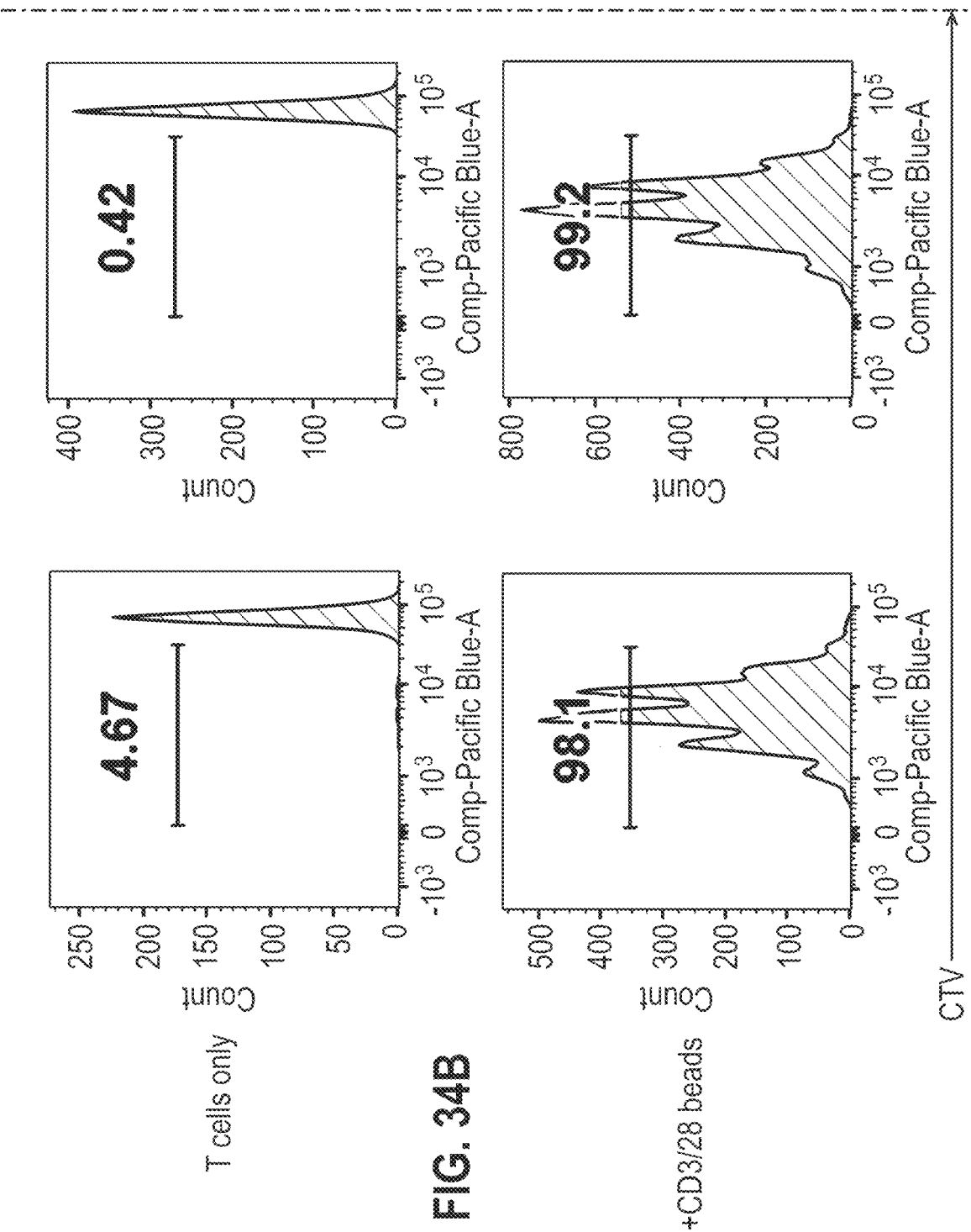

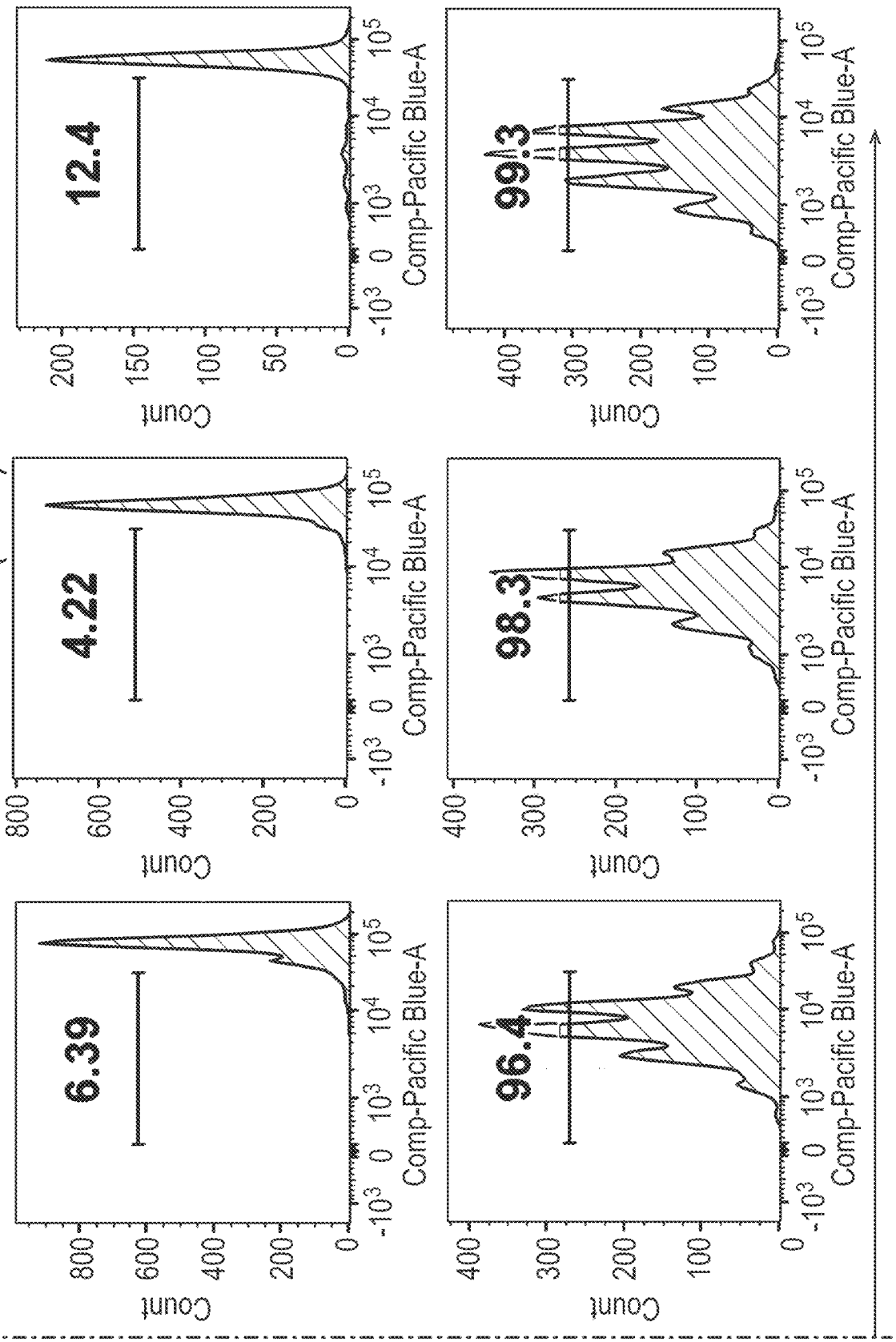
FIG. 34B(contd)

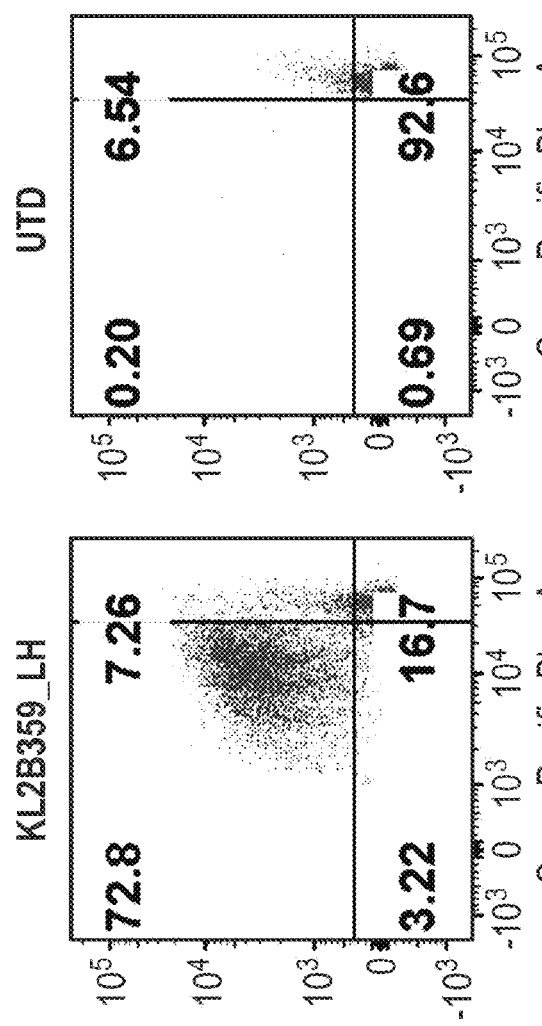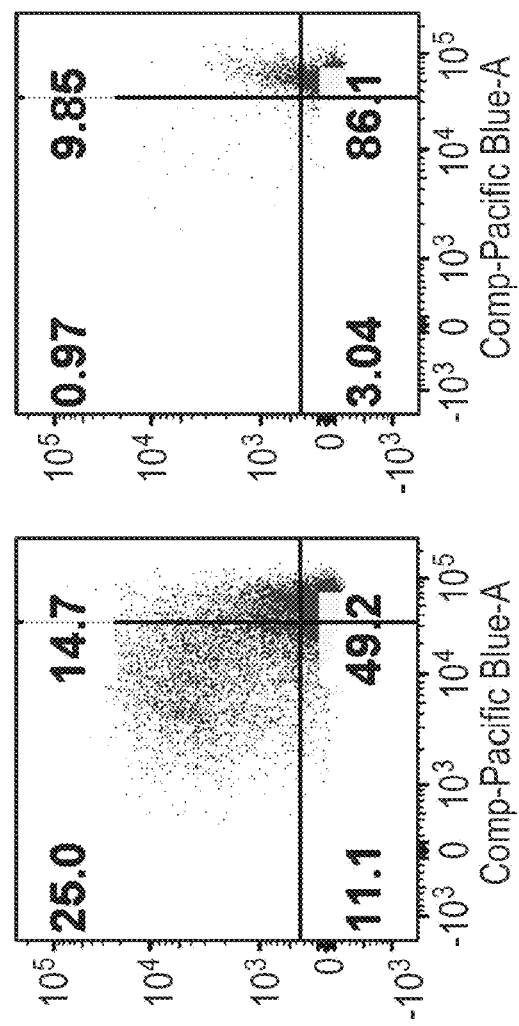
FIG. 36A(cont'd)

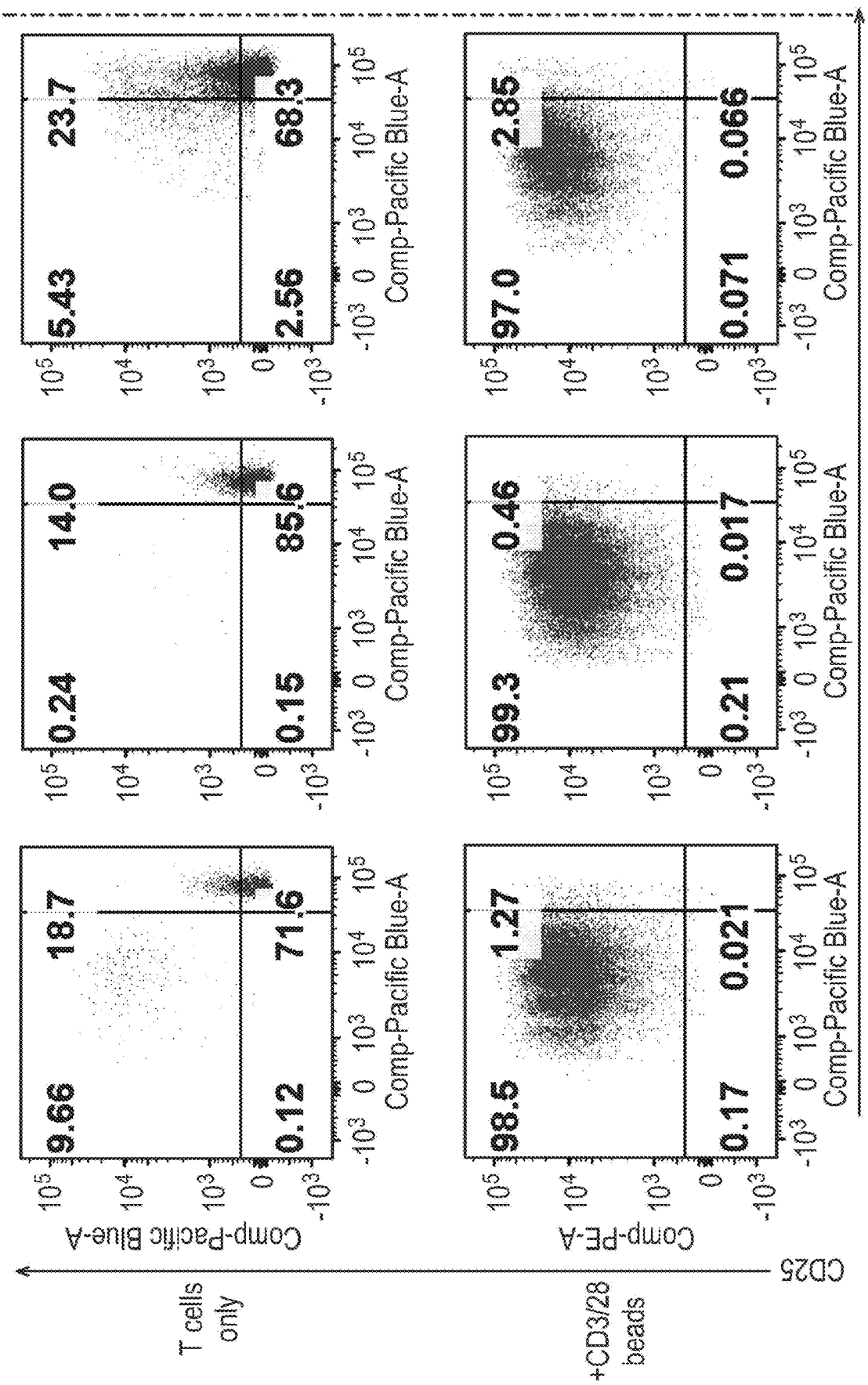

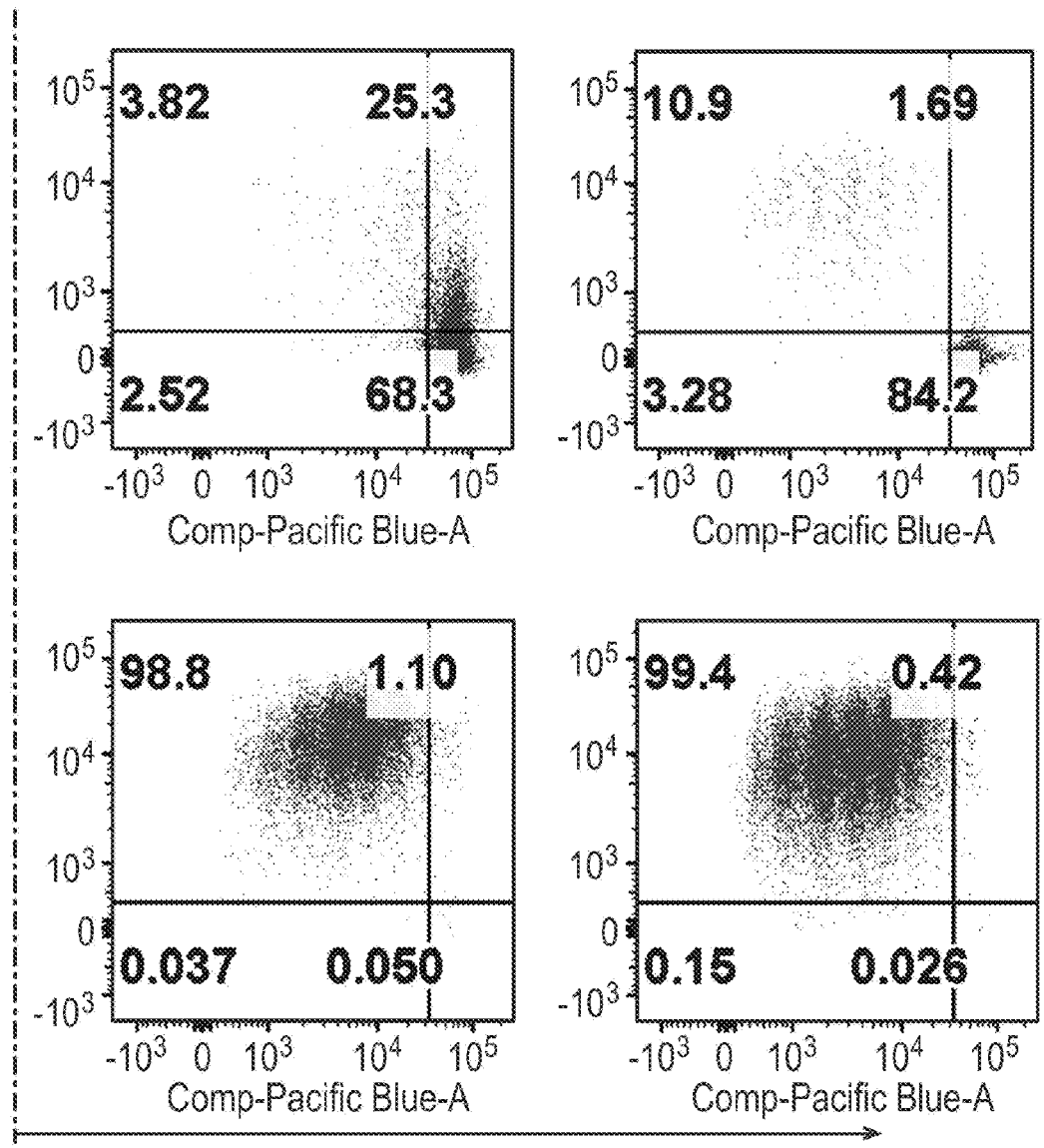
FIG. 36B(contd)

FIG. 38A

Sequence of KL2B494 (Heavy Chain)
QVQLVESGGG LVQPGGSLRL SCAASGFTFS HYAMSWVRQA PGKGLEWVST
IGGSGGSTYY ADSVKGRFTI SRDNSKNTLY LQMNSLRAED TAVYYCAKPH
IVMVTALLYD GMDVWGQGTM VTVSSASTKG PSVFPLAPSS KSTSGGTAAL
GCLVKDYFPE PVTVSWNSGA LTSGVHTFPA VLQSSGLYSL SSVVTVPSSS
LGTQTYICNV NHKPSNTKVD KKVEPKSCDK THTCPPCPAP EAAGGPSVFL
FPPKPKDTLM ISRTPEVTCV VVSVSHEDPE VKFNWYVDGV EVHNAKTKPR
EEQYNSTYRV VSVLTVLHQD WLNGKEYKCK VSNKALPAPI EKTISKAKGQ
PREPQVYTLP PSREEMTKNQ VSLTCLVKGF YPSDIAVEWE SNGQPENNYK
TTPPVLDSDG SFFLYSKLTV DKSRWQQGNV FSCSVMHEAL HNHYTQKSLS
LSPGK

Sequence of KL2B494 (Light chain)
SSELTQPPSV SVAPGQTARI TCGGNNIGSK SVHWYQQKPG QAPVLVVYDD
SDRPSGIPER FSGSNSGNTA TLTISRVEAG DEADYYCQVW DSSSDHVVFG
GGTKLTVLGQ PKAAPSVTLF PPSSEELQAN KATLVCLISD FYPGAVTVAW
KADSSPVKAG VETTTPSKQS NNKYAASSYL SLTPEQWKSH RSYSCQVTHE
GSTVEKTVAP TECS

FIG. 38B

Sequence of KL2B467 (Heavy chain)
QVQLVESGGG VVQPGRSLRL SCAASGFTFS YYGMHWVRQA PGKGLEWVAF
ISYDGSNKYY ADSVKGRFTI SRDNSKNTLY LQMNSLRAED TAVYYCAHLP
YSGSYWAFDY WGQGTQVTVS SASTKGPSVF PLAPSSKSTS GGTAALGCLV
KDYFPEPVTV SWNSGALTSG VHTFPAVLQS SGLYSLSSVV TVPSSSLGTQ
TYICNVNHKP SNTKVDKKVE PKSCDKTHTC PPCPAPEAAG GPSVFLFPPK
PKDTLMISRT PEVTCVVVSV SHEDPEVKFN WYVDGVEVHN AKTKPREEQY
NSTYRVVSVL TVLHQDWLNG KEYKCKVSNK ALPAPIEKTI SKAKGQPREP
QVYTLPPSRE EMTKNQVSLT CLVKGFYPSD IAVEWESNGQ PENNYKTTPP
VLDSDGSFFL YSKLTVDKSR WQQGNVFSCS VMHEALHNHY TQKSLSLSPG
K

Sequence of KL2B467 (Light chain)
QSVLTQPPSV SVAPGQTASI TCGGDNIGSK SVHWYQQKPG QAPVLVYDN
SDRPSGIPER FSGSNSGTTA TLTISRVEAG DEADYYCQVW DSSSDHPVVF
GGGTKVTVLG QPKAAPSVTL FPPSSEELQA NKATLVCLIS DFYPGAVTVA
WKADSSPVKA GVETTTPSKQ SNNKYAASSY LSLTPEQWKS HRSYSCQVTH
EGSTVEKTVA PTECS

FIG. 38C

Sequence of hu11B6 (Heavy chain)
QVQLQESGPG LVKPSDTLSL TCAVSGNSIT SDYAWNWIRQ PPGKGLEWIG
YISYSGSTTY NPSLKSRVTM SRDTSKNQFS LKLSSVTAVD TAVYYCATGY
YYGSGFWGQG TLVTVSSAST KGPSVFPLAP SSKSTSGGTA ALGCLVKDYF
PEPVTVSWNS GALTSGVHTF PAVLQSSGLY SLSSVVTVPS SSLGTQTYIC
NVNHKPSNTK VDKKVEPKSC DKTHTCPPCP APELLGGPSV FLFPPKPKDT
LMISRTPEVT CVVVDVSHED PEVKFNWYVD GVEVHNAKTK PREEQYNSTY
RVVSVLTVLH QDWLNGKEYK CKVSNKALPA PIEKTISKAK GQPREPQVYT
LPPSREEMTK NQVSLTCLVK GFYPSDIAVE WESNGQPENN YKTTPPVLDS
DGSFFLYSKL TVDKSRWQQG NVFSCSVMHE ALHNHYTQKS LSLSPGK

Sequence of hu11B6 (Light chain)
DIVLTQSPDS LAVSLGERAT INCKASESVE YFGTSLMHWY QQKPGQPPKL
LIYAASNRES GVPDRFSGSG SGTDFTLTIS SLQAEDVAVY YCQQTRKVPY
TFGQGTKLEI KRTVAAPSVF IFPPSDEQLK SGTASVVCLL NNFYPREAKV
QWKVDNALQS GNSQESVTEQ DSKDSTYSLS STLTLSKADY EKHKVYACEV
THQGLSSPVT KSFNRGEC

FIG. 38D

Sequence of KL2B413 (Heavy chain)
EVQLVESGGG LVQPGGSLRL SCAASGFTFS SYWMTWVRQP PGKGLEWVAN
IKQDGSERYF VDSVKGRFTI SRDNAKNSLY LQMNSLRAED TAVYYCARIQ
NYDILIGHYG MDVWGQGTTV TVSSASTKGP SVFPLAPCSR STSESTAALG
CLVKDYFPEP VTVSWNSGAL TSGVHTFPAV LQSSGLYSLS SVVTVPSSSL
GTKTYTCNVD HKPSNTKVDK RVESKYGPPC PPCPAPEAAG GPSVFLFPPK
PKDTLMISRT PEVTCVVVDV SQEDPEVQFN WYVDGVEVHN AKTKPREEQF
NSTYRVVSVL TVLHQDWLNG KEYKCKVSNK GLPSSIEKTI SKAKGQPREP
QVYTLPPSQE EMTKNQVSLT CLVKGFYPSD IAVEWESNGQ PENNYKTTPP
VLDSDGSFFL YSRLTVDKSR WQEGNVFSCS VMHEALHNHY TQKSLSLSLG
K

Sequence of KL2B413 (Light chain)
EIVLTQSPSF LSASVGDRVT ITCRASQGIS SYLSWYQQKP GKAPKLLIYA
TSTLQSGVPS RFSGSGSGTE FTLTISSLQP EDFATYYCQQ LNSYPRTFGQ
GTKVEIKRTV AAPSVFIFPP SDEQLKSGTA SVVCLLNNFY PREAKVQWKV
DNALQSGNSQ ESVTEQDSKD STYSLSSTLT LSKADYEKHK VYACEVTHQG
LSSPVTKSFN RGEC

FIG. 38E

Sequence of KL2B30 Fab of KLCB80 bispecific (heavy chain)
QVQLQESGPG LVKPSETLSL TCTVSGGSIS SYYWSWIRQP PGKGLEWIGY
IYYSGSTNYN PSLKSRVTIS VDTSKNQFSL KLSSVTAADT AVYYCAGTII
EGVYIENFYY GMDVWGQGTT VTVSSASTKG PSVFPLAPSS KSTSGGTAAL
GCLVKDYFPE PVTVSWNSGA LTSGVHTFPA VLQSSGLYSL SSVVTVPSSS
LGTQTYICNV NHKPSNTKVD KKVEPKSCDK THTCPPCPAP EAAGGPSVFL
FPPKPKDTLM ISRTPEVTCV VVSVSHEDPE VKFNWYVDGV EVHNAKTKPR
EEQYNSTYRV VSVLTVLHQD WLNGKEYKCK VSNKALPAPI EKTISKAKGQ
PREPQVYVLP PSREEMTKNQ VSLLCLVKGF YPSDIAVEWE SNGQPENNYL
TWPPVLDSDG SFFLYSKLTV DKSRWQQGNV FSCSVMHEAL HNHYTQKSLS
LSPG Sequence of KL2B30 Fab of KLCB80 bispecific (light chain)
DIQMTQSPSF LSASVGDRVT ITCRASQGIS SYLAWYQQKP GKAPKFLIYA
ASTLQSGVPS RFSGSGSGTE FTLTISSLQP EDFATYYCQQ LNSYPLTFGG
GTKVEIKRTV AAPSVFIFPP SDEQLKSGTA SVVCLLNNFY PREAKVQWKV
DNALQSGNSQ ESVTEQDSKD STYSLSSTLT LSKADYEKHK VYACEVTHQG
LSSPVTKSFN RGEC

FIG. 38F

Sequence of KL2B353 Fab of KLCB113 bispecific (heavy chain)
EVQLVESGGG VVQPGRSLRL SCVASGFTFS SYDIHWVRQA PGKGLEWVAI
ISYDGSKKDY TDSVKGRFTI SRDNSKNTLY LQMDSLRVED SAVYSCARES
GWSHYYYGM DVWGQGTMVT VSSASTKGPS VFPLAPSSKS TSGGTAALGC
LVKDYFPEPV TVSWNSGALT SGVHTFPAVL QSSGLYSLSS VVTVPSSSLG
TQTYICNVNH KPSNTKVDKK VEPKSCDKTH TCPPCPAPEA AGGPSVFLFP
PKPKDTLMIS RTPEVTCVVV SVSHEDPEVK FNWYVDGVEV HNAKTKPREE
QYNSTYRVVS VLTVLHQDWL NGKEYKCKVS NKALPAPIEK TISKAKGQPR
EPQVYVLPPS REEMTKNQVS LLCLVKGFYP SDIAVEWESN GQPENNYLTW
PPVLDSDGSF FLYSKLTVDK SRWQQGNVFS CSVMHEALHN HYTQKSLSLS
PG Sequence of KL2B353 Fab of KLCB113 bispecific (heavy chain)
DIVMTQSPSS LSASVGDRVT ITCRASQDIS NYLAWYQQKP GKVPKFLIYA
ASTLHSGVPS RFSGSGSGTD FTLTISSLQP EDVATYYCQK YNSAPYTFGQ
GTRLEIKRTV AAPSVFIFPP SDEQLKSGTA SVVCLLNNFY PREAKVQWKV
DNALQSGNSQ ESVTEQDSKD STYSLSSTLT LSKADYEKHK VYACEVTHQG
LSSPVTKSFN RGEC FIG. 39B
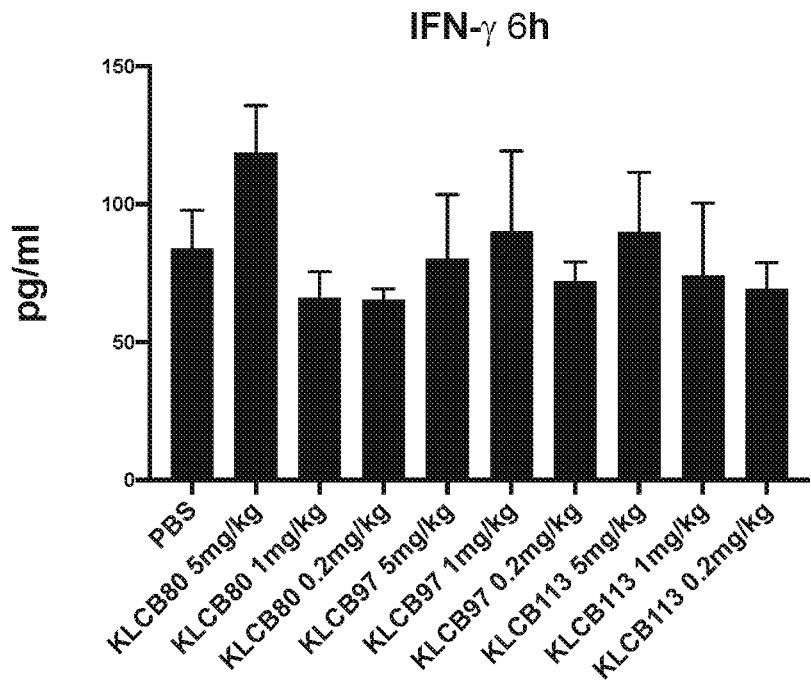
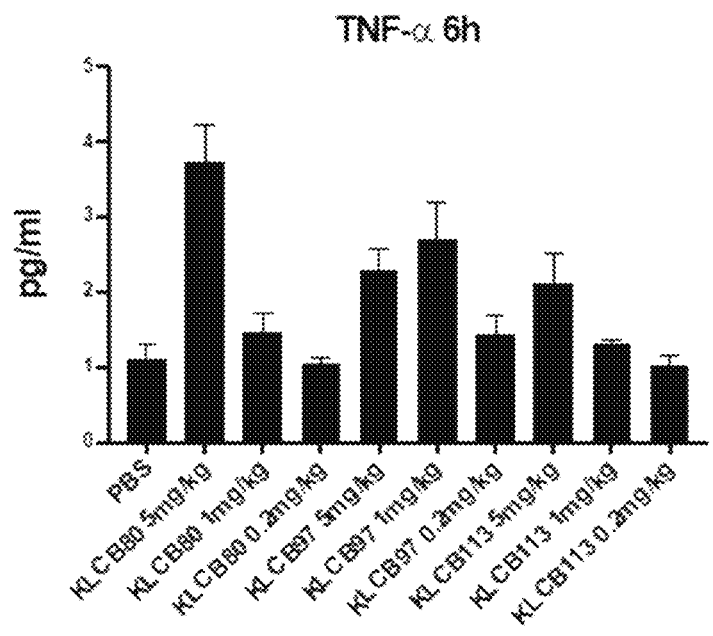

PROTEINS COMPRISING KALLIKREIN RELATED PEPTIDASE 2 ANTIGEN BINDING DOMAINS AND THEIR USES

CROSS-REFERENCE TO RELATED APPLICATIONS

This application claims the benefit of the priority to U.S. Provisional Patent Application No. 62/878,964, filed Jul. 26, 2019, U.S. Provisional Patent Application No. 62/910,650, filed Oct. 4, 2019, and U.S. Provisional Patent Application No. 63/030,445, filed May 27, 2020, the disclosures of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Jul. 23, 2020, is named JBI6125USNP1_SL.txt and is 174,703 bytes in size.

TECHNICAL FIELD

The invention provides antigen binding domains that bind kallikrein related peptidase 2 (hK2) protein comprising the antigen binding domains that bind hK2, polynucleotides encoding them, vectors, host cells, methods of making and using them.

BACKGROUND

Prostate cancer is the second most frequently diagnosed cancer and the sixth leading cause of cancer death in males, accounting for 14% (903,500) of the total new cancer cases and 6% (258,400) of the total cancer deaths in males worldwide. The course of prostate cancer from diagnosis to death is best categorized as a series of clinical stages based on the extent of disease, hormonal status, and absence or presence of detectable metastases: localized disease, rising levels of prostate-specific antigen (PSA) after radiation therapy or surgery with no detectable metastases, and clinical metastases in the non-castrate or castrate stage. Although surgery, radiation, or a combination of both can be curative for patients with localized disease, a significant proportion of these patients have recurrent disease as evidenced by a rising level of PSA, which can lead to the development of metastases, especially in the high-risk group—a transition to the lethal stage of the disease.

Androgen depletion therapy (ADT) is the standard treatment with a generally predictable outcome: decline in PSA, a period of stability in which the tumor does not proliferate, followed by rising PSA and regrowth as castration-resistant disease. Historically, ADT has been the standard of care for patients with metastatic prostate cancer.

Kallikrein related peptidase 2 (hK2, HK2) is a trypsin-like enzyme with androgen receptor (AR)-driven expression specific to prostate tissue and prostate cancer. hK2 is activated by Transmembrane Protease, Serine 2 (TMPRSS2) and secreted into the ducts of the prostate, where it initiates a cascade that cleaves semenogelin, the extracellular matrix in ejaculate, to enhance sperm motility. hK2 expression is restricted to the prostate and prostate cancer tissue, however it has recently been demonstrated that hK2 was detectable in breast cancer lines and primary patient samples after appropriate activation of the AR-pathway by steroid hormones (U.S. Pat. Publ. No. 2018/0326102). Similar to PSA, retrograde release of catalytically inactive hK2 into the blood occurs when the highly structured organization of the prostate is compromised upon hypertrophy or malignant transformation.

There is a need for next generation hK2 binding domains for therapeutic and diagnostic purposes.

SUMMARY

The disclosure provides an isolated protein comprising an antigen binding domain that binds kallikrein related peptidase 2 (hK2), wherein the antigen binding domain that binds hK2 comprises: a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or the HCDR1, the HCDR2 and the HCDR3 of the VH of SEQ ID NO: 137 and the LCDR1, the LCDR2 and the LCDR3 of the VL of SEQ ID NO: 138; or the HCDR1, the HCDR2 and the HCDR3 of the VH of SEQ ID NO: 162 and the LCDR1, the LCDR2 and the LCDR3 of the VL of SEQ ID NO: 163; or the HCDR, the HCDR2 and the HCDR3 of the VH of SEQ ID NO: 164 and the LCDR1, the LCDR2 and the LCDR3 of the VL of SEQ ID NO: 165; or the HCDR1, the HCDR2 and the HCDR3 of the VH of SEQ ID NO: 166 and the LCDR1, the LCDR2 and the LCDR3 of the VL of SEQ ID NO: 167; or the HCDR1, the HCDR2 and the HCDR3 of the VH of SEQ ID NO: 168 and the LCDR1, the LCDR2 and the LCDR3 of the VL of SEQ ID NO: 169; or the HCDR1, the HCDR2 and the HCDR3 of the VH of SEQ ID NO: 204 and the LCDR1, the LCDR2 and the LCDR3 of the VL of SEQ ID NO: 205.

The disclosure also provides an isolated antigen binding domain that binds kallikrein related peptidase 2 (hK2), wherein the antigen binding domain that binds hK2 comprises a heavy chain variable region (VH) of SEQ ID NO: 75 and a light chain variable region (VL) of SEQ ID NO: 74.

The disclosure also provides isolated antigen binding domains that bind hK2 comprising certain VH and VL amino acid sequences.

The disclosure also provides an isolated multispecific protein comprising an antigen binding domain that binds kallikrein related peptidase 2 (hK2), wherein the antigen binding domain that binds hK2 comprises a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or the HCDR1, the HCDR2 and the HCDR3 of the VH of SEQ ID NO: 137 and the LCDR1, the LCDR2 and the LCDR3 of the VL of SEQ ID NO: 138; or the HCDR1, the HCDR2 and the HCDR3 of the VH of SEQ ID NO: 162 and the LCDR1, the LCDR2 and the LCDR3 of the VL of SEQ ID NO: 163; or the HCDR1, the HCDR2 and the HCDR3 of the VH of SEQ ID NO: 164 and the LCDR1, the LCDR2 and the LCDR3 of the VL of SEQ ID NO: 165; or the HCDR1, the HCDR2 and the HCDR3 of the VH of SEQ ID NO: 166 and the LCDR1, the LCDR2 and the LCDR3 of the VL of SEQ ID NO: 167; or the HCDR1, the HCDR2 and the HCDR3 of the VH of SEQ ID NO: 168 and the LCDR1, the LCDR2 and the LCDR3 of the VL of SEQ ID NO: 169; or the HCDR1, the HCDR2 and the HCDR3 of the VH of SEQ ID NO: 204 and the LCDR1, the LCDR2 and the LCDR3 of the VL of SEQ ID NO: 205. In a particular embodiment, the disclosure provides an isolated multispecific protein comprising an antigen binding domain that binds kallikrein related peptidase 2 (hK2), wherein the antigen binding domain that binds hK2 comprises a heavy chain complementarity determining region (HCDR) 1, a HCDR2 and a HCDR3 of a heavy chain variable region (VH) of SEQ ID NO: 162 and a light chain complementarity determining region (LCDR) 1, a LCDR2 and a LCDR3 of a light chain variable region (VL) of SEQ ID NO: 163.

The disclosure also provides an isolated multispecific protein comprising an antigen binding domain that binds kallikrein related peptidase 2 (hK2), wherein the antigen binding domain that binds hK2 comprises a heavy chain variable region (VH) of SEQ ID NO: 75 and a light chain variable region (VL) of SEQ ID NO: 74.

The disclosure also provides isolated multispecific protein comprising an antigen binding domain that bind hK2 comprising certain VH and VL amino acid sequences.

The disclosure also provides an isolated chimeric antigen receptor (CAR) comprising an antigen binding domain that binds kallikrein related peptidase 2 (hK2).

The disclosure also provides an isolated chimeric antigen receptor (CAR) comprising an antigen binding domain that binds kallikrein related peptidase 2 (hK2), wherein the antigen binding domain that binds hK2 comprises a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or the HCDR1, the HCDR2 and the HCDR3 of the VH of SEQ ID NO: 137 and the LCDR1, the LCDR2 and the LCDR3 of the VL of SEQ ID NO: 138; or the HCDR1, the HCDR2 and the HCDR3 of the VH of SEQ ID NO: 162 and the LCDR1, the LCDR2 and the LCDR3 of the VL of SEQ ID NO: 163; or the HCDR1, the HCDR2 and the HCDR3 of the VH of SEQ ID NO: 164 and the LCDR1, the LCDR2 and the LCDR3 of the VL of SEQ ID NO: 165; or the HCDR1, the HCDR2 and the HCDR3 of the VH of SEQ ID NO: 166 and the LCDR1, the LCDR2 and the LCDR3 of the VL of SEQ ID NO: 167; or the HCDR1, the HCDR2 and the HCDR3 of the VH of SEQ ID NO: 168 and the LCDR1, the LCDR2 and the LCDR3 of the VL of SEQ ID NO: 169; or the HCDR1, the HCDR2 and the HCDR3 of the VH of SEQ ID NO: 204 and the LCDR1, the LCDR2 and the LCDR3 of the VL of SEQ ID NO: 205. In a particular embodiment, the disclosure provides an isolated chimeric antigen receptor (CAR) comprising an antigen binding domain that binds kallikrein related peptidase 2 (hK2), wherein the antigen binding domain that binds hK2 comprises a heavy chain complementarity determining region (HCDR) 1, a HCDR2 and a HCDR3 of a heavy chain variable region (VH) of SEQ ID NO: 162 and a light chain complementarity determining region (LCDR) 1, a LCDR2 and a LCDR3 of a light chain variable region (VL) of SEQ ID NO: 163.

The disclosure also provides an isolated chimeric antigen receptor (CAR) comprising an antigen binding domain that binds kallikrein related peptidase 2 (hK2), wherein the antigen binding domain that binds hK2 comprises a heavy chain variable region (VH) of SEQ ID NO: 75 and a light chain variable region (VL) of SEQ ID NO: 74.

The disclosure also provides an isolated multispecific protein comprising a first antigen binding domain that binds hK2 and a second antigen binding domain that binds a lymphocyte antigen (such as CD3).

In a particular embodiment, the present the disclosure provides an isolated multispecific protein comprising a first antigen binding domain that binds hK2 and a second antigen binding domain that binds a lymphocyte antigen, wherein the isolated multispecific protein is an isolated anti hK2/anti CD3 protein.

The disclosure also provides an immunoconjugate comprising the isolated antigen binding domain that binds hK2 of the disclosure.

The disclosure also provides an immunoconjugate comprising the isolated protein comprising the antigen binding domain that binds hK2 of the disclosure.

The disclosure also provides an immunoconjugate comprising the isolated multispecific protein comprising the antigen binding domain that binds hK2 of the disclosure.

The disclosure also provides an immunoconjugate comprising the isolated CAR comprising the antigen binding domain that binds hK2 of the disclosure.

The disclosure also provides a pharmaceutical composition comprising the isolated antigen binding domain that binds hK2 of the disclosure.

The disclosure also provides a pharmaceutical composition comprising the isolated protein comprising the antigen binding domain that binds hK2 of the disclosure.

The disclosure also provides a pharmaceutical composition comprising the isolated multispecific protein comprising the antigen binding domain that binds hK2 of the disclosure.

The disclosure also provides a pharmaceutical composition comprising the isolated multispecific protein of the disclosure.

The disclosure also provides a pharmaceutical composition comprising the isolated CAR comprising the antigen binding domain that binds hK2 of the disclosure.

The disclosure also provides an isolated polynucleotide encoding the isolated antigen binding domain that binds hK2 of the disclosure.

The disclosure also provides an isolated polynucleotide encoding the isolated protein comprising the antigen binding domain that binds hK2 of the disclosure.

The disclosure also provides an isolated polynucleotide encoding the isolated multispecific protein comprising the antigen binding domain that binds hK2 of the disclosure.

The disclosure also provides an isolated polynucleotide encoding the isolated CAR comprising the antigen binding domain that binds hK2 of the disclosure.

The disclosure also provides a vector comprising the polynucleotide of the disclosure.

The disclosure also provides a host cell comprising the polynucleotide or the vector of the disclosure.

The disclosure also provides a method of treating a hK2 expressing cancer in a subject, comprising administering a therapeutically effective amount of the antigen binding domain that binds hK2, the protein comprising the antigen binding domain that binds hK2, the multispecific protein comprising the antigen binding domain that binds hK2, the CAR-T comprising the antigen binding domain that binds hK2, the immunoconjugate of the disclosure or the pharmaceutical composition of the disclosure to the subject in need thereof for a time sufficient to treat the hK2 expressing cancer.

The disclosure also provides a method of reducing the amount of hK2 expressing tumor cells in a subject, comprising administering to the subject the antigen binding domain that binds hK2, the protein comprising the antigen binding domain that binds hK2, the multispecific protein comprising the antigen binding domain that binds hK2, the CAR-T comprising the antigen binding domain that binds hK2, the immunoconjugate of the disclosure or the pharmaceutical composition of the disclosure for a time sufficient to reduce the amount of hK2 expressing tumor cells.

The disclosure also provides a method of preventing establishment of a hK2 expressing cancer in a subject, comprising administering the antigen binding domain that binds hK2, the protein comprising the antigen binding domain that binds hK2, the multispecific protein comprising the antigen binding domain that binds hK2, the CAR-T comprising the antigen binding domain that binds hK2, the immunoconjugate of the disclosure or the pharmaceutical composition of the disclosure to the subject in need thereof to prevent establishment of the hK2 expressing cancer in the subject.

The disclosure also provides a method of treating a noncancerous condition in a subject at risk of developing a hK2 expressing cancerous condition, comprising administering the antigen binding domain that binds hK2, the protein comprising the antigen binding domain that binds hK2, the multispecific protein comprising the antigen binding domain that binds hK2, the CAR-T comprising the antigen binding domain that binds hK2, the immunoconjugate of the disclosure or the pharmaceutical composition of the disclosure to the subject in need thereof to treat the noncancerous condition.

The disclosure also provides a method of treating prostate cancer in a subject, comprising administering a therapeutically effective amount of the antigen binding domain that binds hK2, the protein comprising the antigen binding domain that binds hK2, the multispecific protein comprising the antigen binding domain that binds hK2, the CAR-T comprising the antigen binding domain that binds hK2, the immunoconjugate of the disclosure or the pharmaceutical composition of the disclosure to the subject in need thereof for a time sufficient to treat the prostate cancer.

The disclosure also provides a method of treating breast cancer in a subject, comprising administering a therapeutically effective amount of the antigen binding domain that binds hK2, the protein comprising the antigen binding domain that binds hK2, the multispecific protein comprising the antigen binding domain that binds hK2, the CAR-T comprising the antigen binding domain that binds hK2, the immunoconjugate of the disclosure or the pharmaceutical composition of the disclosure to the subject in need thereof for a time sufficient to treat the breast cancer.

The disclosure also provides a method of detecting prostate cancer or breast cancer in a subject, comprising administering to the subject the immunoconjugate of the disclosure, and detecting binding of the immunoconjugate to hK2, thereby detecting prostate cancer or breast cancer.

The disclosure also provides a kit comprising the antigen binding domain that binds hK2, the protein comprising the antigen binding domain that binds hK2, the multispecific protein comprising the antigen binding domain that binds hK2, the CAR-T comprising the antigen binding domain that binds hK2, the immunoconjugate of the disclosure or the pharmaceutical composition of the disclosure.

The disclosure also provides an anti-idiotypic antibody binding to the antigen binding domain that binds hK2 of the disclosure The disclosure also provides a chimeric antigen receptor (CAR) comprising: an extracellular domain comprising an antigen binding domain that binds hK2; a transmembrane domain; and an intracellular signaling domain optionally comprising at least one co-stimulatory domain.

BRIEF DESCRIPTION OF THE DRAWINGS

The foregoing will be apparent from the following more particular description of example embodiments, as illustrated in the accompanying drawings. TM: transmembrane.

FIG. 1 shows the sequence alignment of the VH domains of mu11B6 (SEQ ID NO: 125), hu11B6 (SEQ ID NO: 5), KL2B357 (SEQ ID NO: 159), KL2B358 (SEQ ID NO: 161), KL2B359 (SEQ ID NO: 139), KL2B360 (SEQ ID NO: 159), HCF3 (SEQ ID NO: 6) and HCG5 (SEQ ID NO: 4).

FIG. 2 shows the sequence alignment of the VL domains of mu11B6 (SEQ ID NO: 124), hu11B6 (SEQ ID NO: 2), KL2B357 (SEQ ID NO: 160), KL2B358 (SEQ ID NO: 140), KL2B359 (SEQ ID NO: 140), KL2B360 (SEQ ID NO: 140), LDC6 (SEQ ID NO: 1) and LCB7 (SEQ ID NO: 3).

FIG. 3 shows the binding epitopes of selected hK2 antibodies mapped onto the sequence of hK2 antigen. The figure discloses each sequence as SEQ ID NO: 467.

FIG. 6 shows the alignment of the VL regions of CD3B815 (SEQ ID NO: 249), CD3W244 (SEQ ID NO: 250), CD3W245 (SEQ ID NO: 251), CD3W246 (SEQ ID NO: 252), CD3W247 (SEQ ID NO: 253), and CD3W248 (SEQ ID NO: 254).

FIG. 22 shows cytokine release by hK2 CAR-T cells. Supernatant collected from overnight (approximately 20 hours) co-culture of hK2 CAR-T cells with VCaP cells at 1:1 of E/T ratio was analyzed using 13-plex Milliplex Human High Sensitivity T cell kit (HSTCMAG28SPMX13). hK2 CAR-T cells secreted cytokines during co-culture with hK2-expressing VCaP cells, but minimally during co-culture with un-transduced T cells (UTD). Mean cytokine concentration±standard deviation (pg/ml) from duplicate cultures is shown.

FIG. 24A and FIG. 24B shows flow cytometry histograms of CellTrace Violet (CTV) labeled untransduced T cells (T cells only in the Figure) or CAR-10-transduced CAR-T after 5-day co-culture with VCaP or DU145 cells, or after stimulation with CD3/28 beads.

FIG. 34A and FIG. 34B show flow cytometry histograms of CellTrace Violet (CTV) labeled untransduced T cells (T cells only in the Figure) or CAR-T cells transduced with CAR17 (KLB413HL in the Figure), CAR18 (KLB413LH in the Figure), CAR19 (KLB359HL in the Figure) and CAR20 (KLB359LH in the Figure) after 5-day co-culture with VCAp or DU145 cells. UTD: untransduced.

FIG. 36A and FIG. 36B show flow cytometry histograms of CTV+CD25+ CAR-T cells transduced with CAR17 (KLB413HL in the Figure), CAR18 (KLB413LH in the Figure), CAR19 (KLB359HL in the Figure) and CAR20 (KLB359LH in the Figure) after 5-day co-culture with VCaP or DU145 cells.

FIG. 38A-38F shows the binding paratope of selected anti-hK2 antibodies and selected anti-hK2/CD3 bispecific antibodies. Underlined sequences indicate CDR regions and highlighted sequences indicate paratope regions. FIG. 38A discloses SEQ ID NOS 219 and 220, respectively, in order of appearance. FIG. 38B discloses SEQ ID NOS 213 and 224, respectively, in order of appearance. FIG. 38C discloses SEQ ID NOS 203 and 215, respectively, in order of appearance. FIG. 38D discloses SEQ ID NOS 468 and 469, respectively, in order of appearance. FIG. 38E discloses SEQ ID NOS 354 and 221, respectively, in order of appearance. FIG. 38F discloses SEQ ID NOS 356 and 222, respectively, in order of appearance.

FIG. 39B shows in vivo efficacy of KLK2×CD3 bispecific antibody in VCaP xenograft mouse model and cytokine profile. 100 µl blood samples were collected from animals via retro-orbital bleed 6 hours post first dose. Plasma was separated from blood sample by high speed centrifugation. A Luminex assay was carried out to quantify IFN-γ and TNF-α concentrations at different KLK2 bispecific doses.

DETAILED DESCRIPTION

Figure 4A:
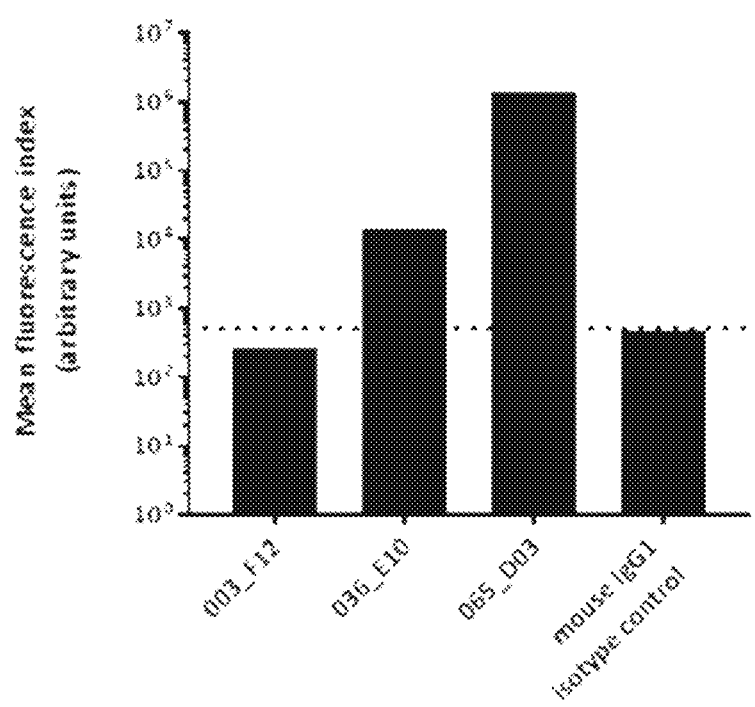
FIGS. 4A and 4B show binding of hybridoma supernatants to primary human T cells. Clone UCHT1 was used as a positive control (FIG. 1B); mouse IgG1 isotype (mIgG1) was used as a negative control.

The disclosed methods may be understood more readily by reference to the following detailed description taken in connection with the accompanying figures, which form a part of this disclosure. It is to be understood that the disclosed methods are not limited to the specific methods described and/or shown herein, and that the terminology used herein is for the purpose of describing particular embodiments by way of example only and is not intended to be limiting of the claimed methods.

All patents, published patent applications and publications cited herein are incorporated by reference as if set forth fully herein.

When a list is presented, unless stated otherwise, it is to be understood that each individual element of that list, and every combination of that list, is a separate embodiment. For example, a list of embodiments presented as "A, B, or C" is to be interpreted as including the embodiments, "A," "B," "C," "A or B," "A or C," "B or C," or "A, B, or C."

As used in this specification and the appended claims, the singular forms "a," "an," and "the" include plural referents unless the content clearly dictates otherwise. Thus, for example, reference to "a cell" includes a combination of two or more cells, and the like.

The transitional terms "comprising," "consisting essentially of," and "consisting of" are intended to connote their generally accepted meanings in the patent vernacular; that is, (i) "comprising," which is synonymous with "including," "containing," or "characterized by," is inclusive or open-ended and does not exclude additional, unrecited elements or method steps; (ii) "consisting of" excludes any element, step, or ingredient not specified in the claim; and (iii) "consisting essentially of" limits the scope of a claim to the specified materials or steps "and those that do not materially affect the basic and novel characteristic(s)" of the claimed invention. Embodiments described in terms of the phrase "comprising" (or its equivalents) also provide as embodiments those independently described in terms of "consisting of" and "consisting essentially of."

"About" means within an acceptable error range for the particular value as determined by one of ordinary skill in the art, which will depend in part on how the value is measured or determined, i.e., the limitations of the measurement system. Unless explicitly stated otherwise within the Examples or elsewhere in the Specification in the context of a particular assay, result or embodiment, "about" means within one standard deviation per the practice in the art, or a range of up to 5%, whichever is larger.

"Activation" or "stimulation" or "activated" or "stimulated" refers to induction of a change in the biologic state of a cell resulting in expression of activation markers, cytokine production, proliferation or mediating cytotoxicity of target cells. Cells may be activated by primary stimulatory signals. Co-stimulatory signals can amplify the magnitude of the primary signals and suppress cell death following initial stimulation resulting in a more durable activation state and thus a higher cytotoxic capacity. A "co-stimulatory signal" refers to a signal, which in combination with a primary signal, such as TCR/CD3 ligation, leads to T cell and/or NK cell proliferation and/or upregulation or downregulation of key molecules.

"Alternative scaffold" refers to a single chain protein framework that contains a structured core associated with variable domains of high conformational tolerance. The variable domains tolerate variation to be introduced without compromising scaffold integrity, and hence the variable domains can be engineered and selected for binding to a specific antigen.

"Antibody-dependent cellular cytotoxicity", "antibody-dependent cell-mediated cytotoxicity" or "ADCC" refers to the mechanism of inducing cell death that depends upon the interaction of antibody-coated target cells with effector cells possessing lytic activity, such as natural killer cells (NK), monocytes, macrophages and neutrophils via Fc gamma receptors (FcγR) expressed on effector cells.

"Antibody-dependent cellular phagocytosis" or "ADCP" refers to the mechanism of elimination of antibody-coated target cells by internalization by phagocytic cells, such as macrophages or dendritic cells.

"Antigen" refers to any molecule (e.g., protein, peptide, polysaccharide, glycoprotein, glycolipid, nucleic acid, portions thereof, or combinations thereof) capable of being bound by an antigen binding domain or a T-cell receptor capable of mediating an immune response. Exemplary immune responses include antibody production and activation of immune cells, such as T cells, B cells or NK cells. Antigens may be expressed by genes, synthetized, or purified from biological samples such as a tissue sample, a tumor sample, a cell or a fluid with other biological components, organisms, subunits of proteins/antigens, killed or inactivated whole cells or lysates.

"Antigen binding fragment" or "antigen binding domain" refers to a portion of the protein that binds an antigen. Antigen binding fragments may be synthetic, enzymatically obtainable or genetically engineered polypeptides and include portions of an immunoglobulin that bind an antigen, such as the VH, the VL, the VH and the VL, Fab, Fab', F(ab')$_2$, Fd and Fv fragments, domain antibodies (dAb) consisting of one VH domain or one VL domain, shark variable IgNAR domains, camelized VH domains, VHH domains, minimal recognition units consisting of the amino acid residues that mimic the CDRs of an antibody, such as FR3-CDR3-FR4 portions, the HCDR1, the HCDR2 and/or the HCDR3 and the LCDR1, the LCDR2 and/or the LCDR3, alternative scaffolds that bind an antigen, and multispecific proteins comprising the antigen binding fragments. Antigen binding fragments (such as VH and VL) may be linked together via a synthetic linker to form various types of single antibody designs where the VH/VL domains may pair intramolecularly, or intermolecularly in those cases when the VH and VL domains are expressed by separate single chains, to form a monovalent antigen binding domain, such as single chain Fv (scFv) or diabody. Antigen binding fragments may also be conjugated to other antibodies, proteins, antigen binding fragments or alternative scaffolds which may be monospecific or multispecific to engineer bispecific and multispecific proteins.

"Antibodies" is meant in a broad sense and includes immunoglobulin molecules including monoclonal antibodies including murine, human, humanized and chimeric monoclonal antibodies, antigen binding fragments, multispecific antibodies, such as bispecific, trispecific, tetraspecific, dimeric, tetrameric or multimeric antibodies, single chain antibodies, domain antibodies and any other modified configuration of the immunoglobulin molecule that comprises an antigen binding site of the required specificity. "Full length antibodies" are comprised of two heavy chains (HC) and two light chains (LC) inter-connected by disulfide bonds as well as multimers thereof (e.g. IgM). Each heavy chain is comprised of a heavy chain variable region (VH) and a heavy chain constant region (comprised of domains CH1, hinge, CH2 and CH3). Each light chain is comprised of a light chain variable region (VL) and a light chain constant region (CL). The VH and the VL regions may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4. Immunoglobulins may be assigned to five major classes, IgA, IgD, IgE, IgG and IgM, depending on the heavy chain constant domain amino acid sequence. IgA and IgG are further sub-classified as the isotypes IgA1, IgA2, IgG1, IgG2, IgG3 and IgG4. Antibody light chains of any vertebrate species may be assigned to one of two clearly distinct types, namely kappa (κ) and lambda (λ), based on the amino acid sequences of their constant domains.

"Bispecific" refers to a molecule (such as an antibody) that specifically binds two distinct antigens or two distinct epitopes within the same antigen. The bispecific molecule may have cross-reactivity to other related antigens, for example to the same antigen from other species (homologs), such as human or monkey, for example *Macaca cynomolgus* (cynomolgus, cyno) or *Pan troglodytes*, or may bind an epitope that is shared between two or more distinct antigens.

"Bispecific anti-hK2/anti-CD3 antibody", "hk2/CD3 antibody", "hk2×CD3 antibody," "anti-hK2/anti-CD3 protein," and the like refer to an antibody that binds hk2 and CD3 and that comprises at least one binding domain specifically binding hK2 and at least one binding domain specifically binding CD3. The domains specifically binding hK2 and CD3 are typically $V_H/V_L$ pairs. The bispecific anti-hk2×CD3 antibody may be monovalent in terms of its binding to either hk2 or CD3.

"Cancer" refers to a broad group of various diseases characterized by the uncontrolled growth of abnormal cells in the body. Unregulated cell division and growth results in the formation of malignant tumors that invade neighboring tissues and may also metastasize to distant parts of the body through the lymphatic system or bloodstream. A "cancer" or "cancer tissue" can include a tumor.

"Chimeric antigen receptor" (CAR) as used herein is defined as a cell-surface receptor comprising an extracellular target-binding domain, a transmembrane domain and an intracellular signaling domain, all in a combination that is not naturally found together on a single protein. This includes receptors wherein the extracellular domain and the intracellular signaling domain are not naturally found together on a single receptor protein. CARs are intended primarily for use with lymphocyte such as T cells and natural killer (NK) cells.

"Complement-dependent cytotoxicity" or "CDC", refers to the mechanism of inducing cell death in which the Fc effector domain of a target-bound protein binds and activates complement component C1q which in turn activates the complement cascade leading to target cell death. Activation of complement may also result in deposition of complement components on the target cell surface that facilitate CDC by binding complement receptors (e.g., CR3) on leukocytes.

"Complementarity determining regions" (CDR) are antibody regions that bind an antigen. There are three CDRs in the VH (HCDR1, HCDR2, HCDR3) and three CDRs in the VL (LCDR1, LCDR2, LCDR3). CDRs may be defined using various delineations such as Kabat (Wu et al. (1970) J Exp Med 132: 211-50; Kabat et al., Sequences of Proteins of Immunological Interest, 5th Ed. Public Health Service, National Institutes of Health, Bethesda, Md., 1991), Chothia (Chothia et al. (1987) J Mol Biol 196: 901-17), IMGT (Lefranc et al. (2003) Dev Comp Immunol 27: 55-77) and AbM (Martin and Thornton J Bmol Biol 263: 800-15, 1996). The correspondence between the various delineations and variable region numbering is described (see e.g. Lefranc et al. (2003) Dev Comp Immunol 27: 55-77; Honegger and Pluckthun, J Mol Biol (2001) 309:657-70, International ImMunoGeneTics (IMGT) database; Web resources, http://www_imgt_org). Available programs such as abYsis by UCL Business PLC may be used to delineate CDRs. The term "CDR", "HCDR1", "HCDR2", "HCDR3", "LCDR1", "LCDR2" and "LCDR3" as used herein includes CDRs defined by any of the methods described supra, Kabat, Chothia, IMGT or AbM, unless otherwise explicitly stated in the specification.

"CD3" refers to an antigen which is expressed on T cells as part of the multimolecular T cell receptor (TCR) complex and which consists of a homodimer or heterodimer formed from the association of two or four receptor chains: CD3 epsilon, CD3 delta, CD3 zeta and CD3 gamma. Human CD3 epsilon comprises the amino acid sequence of SEQ ID NO: 442. All references to proteins, polypeptides and protein fragments herein are intended to refer to the human version of the respective protein, polypeptide or protein fragment unless explicitly specified as being from a non-human species. Thus, "CD3" means human CD3 unless specified as being from a non-human species, e.g., "mouse CD3" "monkey CD3," etc.

Throughout the specification, "CD3-specific" or "specifically binds CD3" or "anti-CD3 antibody" refers to antibodies that bind specifically to the CD3-epsilon polypeptide (SEQ ID NO:442), including antibodies that bind specifically to the CD3-epsilon extracellular domain (ECD) (SEQ ID NO:443). CD3-epsilon, together with CD3-gamma, -delta and -zeta, and the T-cell receptor alpha/beta and gamma/delta heterodimers, forms the T-cell receptor-CD3 complex. This complex plays an important role in coupling antigen recognition to several intracellular signal-transduction pathways. The CD3 complex mediates signal transduction, resulting in T cell activation and proliferation. CD3 is required for the immune response.

(Human CD3 epsilon)
SEQ ID NO: 442
MQSGTHWRVLGLCLLSVGNAVGQDGNEEMGGITQTPYKVSISGTTVILTC

PQYPGSEILWQHNDKNIGGDEDDKNIGSDEDHLSLKEFSELEQSGYYVCY

PRGSKPEDANFYLYLRARVCENCMEMDVMSVATIVIVDICITGGLLLLVY

YWSKNRKAKAKPVTRGAGAGGRQRCQNKERPPPVPNPDYEPIRKGQRDLY

SGLNQRRI (Human CD3 epsilon extracellular domain)
SEQ ID NO: 443
DGNEEMGGITQTPYKVSISGTTVILTCPQYPGSEILWQHNDKNIGGDEDD

KNIGSDEDHLSLKEFSELEQSGYYVCYPRGSKPEDANFYLYLRARVCENC

MEMD

"Decrease," "lower," "lessen," "reduce," or "abate" refers generally to the ability of a test molecule to mediate a reduced response (i.e., downstream effect) when compared to the response mediated by a control or a vehicle. Exemplary responses are T cell expansion. T cell activation or T-cell mediated tumor cell killing or binding of a protein to its antigen or receptor, enhanced binding to a Fcγ or enhanced Fc effector functions such as enhanced ADCC, CDC and/or ADCP. Decrease may be a statistically significant difference in the measured response between the test molecule and the control (or the vehicle), or a decrease in the measured response, such as a decrease of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7, 1.8, etc.).

"Differentiation" refers to a method of decreasing the potency or proliferation of a cell or moving the cell to a more developmentally restricted state.

"Encode" or "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence, and the non-coding strand, used as the template for transcription of a gene or cDNA, can be referred to as encoding the protein or other product of that gene or cDNA.

"Enhance," "promote," "increase," "expand" or "improve" refers generally to the ability of a test molecule to mediate a greater response (i.e., downstream effect) when compared to the response mediated by a control or a vehicle. Exemplary responses are T cell expansion, T cell activation or T-cell mediated tumor cell killing or binding of a protein to its antigen or receptor, enhanced binding to a Fcγ or enhanced Fc effector functions such as enhanced ADCC, CDC and/or ADCP. Enhance may be a statistically significant difference in the measured response between the test molecule and control (or vehicle), or an increase in the measured response, such as an increase of about 1.1, 1.2, 1.5, 2, 3, 4, 5, 6, 7, 8, 9, 10, 15, 20 or 30 fold or more, such as 500, 600, 700, 800, 900 or 1000 fold or more (including all integers and decimal points in between and above 1, e.g., 1.5, 1.6, 1.7, 1.8, etc.).

"Epitope" refers to a portion of an antigen to which an antibody specifically binds. Epitopes typically consist of chemically active (such as polar, non-polar or hydrophobic) surface groupings of moieties such as amino acids or polysaccharide side chains and may have specific three-dimensional structural characteristics, as well as specific charge characteristics. An epitope may be composed of contiguous and/or discontinuous amino acids that form a conformational spatial unit. For a discontinuous epitope, amino acids from differing portions of the linear sequence of the antigen come in close proximity in 3-dimensional space through the folding of the protein molecule. Antibody "epitope" depends on the methodology used to identify the epitope.

"Expansion" refers to the outcome of cell division and cell death.

"Express" and "expression" refers the to the well-known transcription and translation occurring in cells or in vitro. The expression product, e.g., the protein, is thus expressed by the cell or in vitro and may be an intracellular, extracellular or a transmembrane protein.

"Expression vector" refers to a vector that can be utilized in a biological system or in a reconstituted biological system to direct the translation of a polypeptide encoded by a polynucleotide sequence present in the expression vector.

"dAb" or "dAb fragment" refers to an antibody fragment composed of a VH domain (Ward et al., Nature 341:544 546 (1989)).

"Fab" or "Fab fragment" refers to an antibody fragment composed of VH, CH1, VL and CL domains.

"F(ab')$_2$" or "F(ab')$_2$ fragment" refers to an antibody fragment containing two Fab fragments connected by a disulfide bridge in the hinge region.

"Fd" or "Fd fragment" refers to an antibody fragment composed of VH and CH1 domains.

"Fv" or "Fv fragment" refers to an antibody fragment composed of the VH and the VL domains from a single arm of the antibody. Fv fragments lack the constant regions of Fab (CH1 and CL) regions. The VH and VL in Fv fragments are held together by non-covalent interactions.

"Fc" polypeptide" of a dimeric Fc refers to one of the two polypeptide forming the dimeric Fc domain. For example, an Fc polypeptide of a dimeric IgG FC comprises an IgG CH2 and an IgG CH3 constant domain sequence).

"Full length antibody" is comprised of two heavy chains (HC) and two light chains (LC) inter-connected by disulfide bonds as well as multimers thereof (e.g. IgM). Each heavy chain is comprised of a heavy chain variable domain (VH) and a heavy chain constant domain, the heavy chain constant domain comprised of subdomains CH1, hinge, CH2 and CH3. Each light chain is comprised of a light chain variable domain (VL) and a light chain constant domain (CL). The VH and the VL may be further subdivided into regions of hypervariability, termed complementarity determining regions (CDR), interspersed with framework regions (FR). Each VH and VL is composed of three CDRs and four FR segments, arranged from amino-to-carboxy-terminus in the following order: FR1, CDR1, FR2, CDR2, FR3, CDR3 and FR4.

"Genetic modification" refers to the introduction of a "foreign" (i.e., extrinsic or extracellular) gene, DNA or RNA sequence to a host cell, so that the host cell will express the introduced gene or sequence to produce a desired substance, typically a protein or enzyme coded by the introduced gene or sequence. The introduced gene or sequence may also be called a "cloned" or "foreign" gene or sequence, may include regulatory or control sequences operably linked to polynucleotide encoding the chimeric antigen receptor, such as start, stop, promoter, signal, secretion, or other sequences used by a cell's genetic machinery. The gene or sequence may include nonfunctional sequences or sequences with no known function. A host cell that receives and expresses introduced DNA or RNA has been "genetically engineered." The DNA or RNA introduced to a host cell can come from any source, including cells of the same genus or species as the host cell, or from a different genus or species.

"Heterologous" refers to two or more polynucleotides or two or more polypeptides that are not found in the same relationship to each other in nature.

"Heterologous polynucleotide" refers to a non-naturally occurring polynucleotide that encodes two or more neoantigens as described herein.

"Heterologous polypeptide" refers to a non-naturally occurring polypeptide comprising two or more neoantigen polypeptides as described herein.

"Host cell" refers to any cell that contains a heterologous nucleic acid. An exemplary heterologous nucleic acid is a vector (e.g., an expression vector).

"Human antibody" refers to an antibody that is optimized to have minimal immune response when administered to a human subject. Variable regions of human antibody are derived from human immunoglobulin sequences. If human antibody contains a constant region or a portion of the constant region, the constant region is also derived from human immunoglobulin sequences. Human antibody comprises heavy and light chain variable regions that are "derived from" sequences of human origin if the variable regions of the human antibody are obtained from a system that uses human germline immunoglobulin or rearranged immunoglobulin genes. Such exemplary systems are human immunoglobulin gene libraries displayed on phage, and transgenic non-human animals such as mice or rats carrying human immunoglobulin loci. "Human antibody" typically contains amino acid differences when compared to the immunoglobulins expressed in humans due to differences between the systems used to obtain the human antibody and human immunoglobulin loci, introduction of somatic mutations or intentional introduction of substitutions into the frameworks or CDRs, or both. Typically, "human antibody" is at least about 80%, 81%, 82%, 83%, 84%, 85%, 86%, 87%, 88%, 89%, 90%, 91%, 92%, 93%, 94%, 95%, 96%, 97%, 98% or 99% identical in amino acid sequence to an amino acid sequence encoded by human germline immunoglobulin or rearranged immunoglobulin genes. In some cases, "human antibody" may contain consensus framework sequences derived from human framework sequence analyses, for example as described in Knappik et al., (2000) J Mol Biol 296:57-86, or a synthetic HCDR3 incorporated into human immunoglobulin gene libraries displayed on phage, for example as described in Shi et al., (2010) J Mol Biol 397:385-96, and in Int. Patent Publ. No. WO2009/085462. Antibodies in which at least one CDR is derived from a non-human species are not included in the definition of "human antibody".

"Humanized antibody" refers to an antibody in which at least one CDR is derived from non-human species and at least one framework is derived from human immunoglobulin sequences. Humanized antibody may include substitutions in the frameworks so that the frameworks may not be exact copies of expressed human immunoglobulin or human immunoglobulin germline gene sequences.

"In combination with" means that two or more therapeutic agents are be administered to a subject together in a mixture, concurrently as single agents or sequentially as single agents in any order.

"Intracellular signaling domain" or "cytoplasmic signaling domain" refers to an intracellular portion of a molecule. It is the functional portion of the protein which acts by transmitting information within the cell to regulate cellular activity via defined signaling pathways by generating second messengers or functioning as effectors by responding to such messengers. The intracellular signaling domain generates a signal that promotes an immune effector function of the CAR containing cell, e.g., a CAR-T cell.

"Isolated" refers to a homogenous population of molecules (such as synthetic polynucleotides or polypeptides) which have been substantially separated and/or purified away from other components of the system the molecules are produced in, such as a recombinant cell, as well as a protein that has been subjected to at least one purification or isolation step. "Isolated" refers to a molecule that is substantially free of other cellular material and/or chemicals and encompasses molecules that are isolated to a higher purity, such as to 80%, 81%, 82%, 83%, 84%, 85%, 86%, 87%, 88%, 89%, 90%, 91%, 92%, 93%, 94%, 95%, 96%, 97%, 98%, 99% or 100% purity.

"Kallikrein related peptidase 2" or "hK2" refers to a known protein which is also called kallikrein-2, grandular kallikrein 2, or HK2. hK2 is produced as a preproprotein and cleaved during proteolysis to generate active protease. All hK2 isoforms and variants are encompassed in "hK2". The amino acid sequences of the various isoforms are retrievable from GenBank accession numbers NP_005542.1, NP_001002231.1 and NP_001243009. The amino acid sequence of a full length hK2 is shown in SEQ ID NO: 62. The sequence includes the signal peptide (residues 1-18) and the pro-peptide region (residues 19-24).

SEQ ID NO: 62
MWDLVLSIALSVGCTGAVPLIQSRIVGGWECEKHSQPWQVAVYSHGWAHC

GGVLVHPQWVLTAAHCLKKNSQVWLGRHNLFEPEDTGQRVPVSHSFPHPL

YNMSLLKHQSLRPDEDSSHDLMLLRLSEPAKITDVVKVLGLPTQEPALGT

TCYASGWGSIEPEEFLRPRSLQCVSLHLLSNDMCARAYSEKVTEFMLCAG

LWTGGKDTCGGDSGGPLVCNGVLQGITSWGPEPCALPEKPAVYTKVVHYR

KWIKDTIAANP

"Modulate" refers to either enhanced or decreased ability of a test molecule to mediate an enhanced or a reduced response (i.e., downstream effect) when compared to the response mediated by a control or a vehicle.

"Monoclonal antibody" refers to an antibody obtained from a substantially homogenous population of antibody molecules, i.e., the individual antibodies comprising the population are identical except for possible well-known alterations such as removal of C-terminal lysine from the antibody heavy chain or post-translational modifications such as amino acid isomerization or deamidation, methionine oxidation or asparagine or glutamine deamidation. Monoclonal antibodies typically bind one antigenic epitope. A bispecific monoclonal antibody binds two distinct antigenic epitopes. Monoclonal antibodies may have heterogeneous glycosylation within the antibody population. Monoclonal antibody may be monospecific or multispecific such as bispecific, monovalent, bivalent or multivalent.

"Multispecific" refers to a molecule, such as an antibody that specifically binds two or more distinct antigens or two or more distinct epitopes within the same antigen. Multispecific molecule may have cross-reactivity to other related antigens, for example to the same antigen from other species (homologs), such as human or monkey, for example *Macaca fascicularis* (cynomolgus, cyno) or *Pan troglodytes*, or may bind an epitope that is shared between two or more distinct antigens.

"Natural killer cell" and "NK cell" are used interchangeably and synonymously herein. NK cell refers to a differentiated lymphocyte with a $CD16^+$ $CD56^+$ and/or $CD57^+$ $TCR^-$ phenotype. NK cells are characterized by their ability to bind to and kill cells that fail to express "self" MHC/HLA antigens by the activation of specific cytolytic enzymes, the ability to kill tumor cells or other diseased cells that express a ligand for NK activating receptors, and the ability to release protein molecules called cytokines that stimulate or inhibit the immune response.

"Operatively linked" and similar phrases, when used in reference to nucleic acids or amino acids, refers to the operational linkage of nucleic acid sequences or amino acid sequence, respectively, placed in functional relationships with each other. For example, an operatively linked promoter, enhancer elements, open reading frame, 5' and 3' UTR, and terminator sequences result in the accurate production of a nucleic acid molecule (e.g., RNA) and in some instances to the production of a polypeptide (i.e., expression of the open reading frame). Operatively linked peptide refers to a peptide in which the functional domains of the peptide are placed with appropriate distance from each other to impart the intended function of each domain.

The term "paratope" refers to the area or region of an antibody molecule which is involved in binding of an antigen and comprise residues that interact with an antigen. A paratope may composed of continuous and/or discontinuous amino acids that form a conformational spatial unit. The paratope for a given antibody can be defined and characterized at different levels of details using a variety of experimental and computational methods. The experimental methods include hydrogen/deuterium exchange mass spectrometry (HX-MS). The paratope will be defined differently depending on the mapping method employed.

"Pharmaceutical combination" refers to a combination of two or more active ingredients administered either together or separately.

"Pharmaceutical composition" refers to a composition that results from combining an active ingredient and a pharmaceutically acceptable carrier.

"Pharmaceutically acceptable carrier" or "excipient" refers to an ingredient in a pharmaceutical composition, other than the active ingredient, which is nontoxic to a subject. Exemplary pharmaceutically acceptable carriers are a buffer, stabilizer or preservative.

"Polynucleotide" or "nucleic acid" refers to a synthetic molecule comprising a chain of nucleotides covalently linked by a sugar-phosphate backbone or other equivalent covalent chemistry. cDNA is a typical example of a polynucleotide. Polynucleotide may be a DNA or a RNA molecule.

"Prevent," "preventing," "prevention," or "prophylaxis" of a disease or disorder means preventing that a disorder occurs in a subject.

"Proliferation" refers to an increase in cell division, either symmetric or asymmetric division of cells.

"Promoter" refers to the minimal sequences required to initiate transcription. Promoter may also include enhancers or repressor elements which enhance or suppress transcription, respectively.

"Protein" or "polypeptide" are used interchangeably herein are refers to a molecule that comprises one or more polypeptides each comprised of at least two amino acid residues linked by a peptide bond. Protein may be a monomer, or may be protein complex of two or more subunits, the subunits being identical or distinct. Small polypeptides of less than 50 amino acids may be referred to as "peptides". Protein may be a heterologous fusion protein, a glycoprotein, or a protein modified by post-translational modifications such as phosphorylation, acetylation, myristoylation, palmitoylation, glycosylation, oxidation, formylation, amidation, citrullination, polyglutamylation, ADP-ribosylation, pegylation or biotinylation. Protein may be recombinantly expressed.

"Recombinant" refers to polynucleotides, polypeptides, vectors, viruses and other macromolecules that are prepared, expressed, created or isolated by recombinant means.

"Regulatory element" refers to any cis- or trans acting genetic element that controls some aspect of the expression of nucleic acid sequences.

"Relapsed" refers to the return of a disease or the signs and symptoms of a disease after a period of improvement after prior treatment with a therapeutic.

"Refractory" refers to a disease that does not respond to a treatment. A refractory disease can be resistant to a treatment before or at the beginning of the treatment, or a refractory disease can become resistant during a treatment.

"Single chain Fv" or "scFv" refers to a fusion protein comprising at least one antibody fragment comprising a light chain variable region (VL) and at least one antibody fragment comprising a heavy chain variable region (VH), wherein the VL and the VH are contiguously linked via a polypeptide linker, and capable of being expressed as a single chain polypeptide. Unless specified, as used herein, a scFv may have the VL and VH variable regions in either order, e.g., with respect to the N-terminal and C-terminal ends of the polypeptide, the scFv may comprise VL-linker-VH or may comprise VH-linker-VL.

"(scFv)$_2$" or "tandem scFv" or "bis-scFv" fragments refers to a fusion protein comprising two light chain variable region (VL) and two heavy chain variable region (VH), wherein the two VL and the two VH regions are contiguously linked via polypeptide linkers, and capable of being expressed as a single chain polypeptide. The two VL and two VH regions fused by peptide linkers form a bivalent molecule $VL_A$-linker-$VH_A$-linker-$VL_B$-linker-$VH_B$ to form two binding sites, capable of binding two different antigens or epitopes concurrently.

"Specifically binds," "specific binding," "specifically binding" or "binds" refer to a proteinaceous molecule binding to an antigen or an epitope within the antigen with greater affinity than for other antigens. Typically, the proteinaceous molecule binds to the antigen or the epitope within the antigen with an equilibrium dissociation constant ($K_D$) of about $1\times10^{-7}$ M or less, for example about $5\times10^{-8}$ M or less, about $1\times10^{-8}$ M or less, about $1\times10^{-9}$ M or less, about $1\times10^{-10}$ M or less, about $1\times10^{-11}$ M or less, or about $1\times10^{-12}$ M or less, typically with the $K_D$ that is at least one hundred fold less than its $K_D$ for binding to a non-specific antigen (e.g., BSA, casein). In the context of the prostate neoantigens described here, "specific binding" refers to binding of the proteinacous molecule to the prostate neoantigen without detectable binding to a wild-type protein the neoantigen is a variant of.

"Subject" includes any human or nonhuman animal. "Nonhuman animal" includes all vertebrates, e.g., mammals and non-mammals, such as nonhuman primates, sheep, dogs, cats, horses, cows, chickens, amphibians, reptiles, etc. The terms "subject" and "patient" can be used interchangeably herein.

"T cell" and "T lymphocyte" are interchangeable and used synonymously herein. T cell includes thymocytes, naïve T lymphocytes, memory T cells, immature T lymphocytes, mature T lymphocytes, resting T lymphocytes, or activated T lymphocytes. A T cell can be a T helper (Th) cell, for example a T helper 1 (Th1) or a T helper 2 (Th2) cell. The T cell can be a helper T cell (HTL; CD4$^+$ T cell) CD4$^+$ T cell, a cytotoxic T cell (CTL; CD8$^+$ T cell), a tumor infiltrating cytotoxic T cell (TIL; CD8$^+$ T cell), CD4$^+$CD8$^+$ T cell, or any other subset of T cells. Also included are "NKT cells", which refer to a specialized population of T cells that express a semi-invariant αβ T-cell receptor, but also express a variety of molecular markers that are typically associated with NK cells, such as NK1.1. NKT cells include NK1.1$^+$ and NK1.1$^-$, as well as CD4$^+$, CD4$^-$, CD8$^+$ and CD8$^-$ cells. The TCR on NKT cells is unique in that it recognizes glycolipid antigens presented by the MHC I-like molecule CD Id. NKT cells can have either protective or deleterious effects due to their abilities to produce cytokines that promote either inflammation or immune tolerance. Also included are "gamma-delta T cells (γδ T cells)," which refer to a specialized population that to a small subset of T cells possessing a distinct TCR on their surface, and unlike the majority of T cells in which the TCR is composed of two glycoprotein chains designated α- and β-TCR chains, the TCR in γδ T cells is made up of a γ-chain and a δ-chain. γδ T cells can play a role in immunosurveillance and immunoregulation and were found to be an important source of IL-17 and to induce robust CD8$^+$ cytotoxic T cell response. Also included are "regulatory T cells" or "Tregs" which refer to T cells that suppress an abnormal or excessive immune response and play a role in immune tolerance. Tregs are typically transcription factor Foxp3-positive CD4$^+$T cells and can also include transcription factor Foxp3-negative regulatory T cells that are IL-10-producing CD4$^+$T cells.

"Therapeutically effective amount" or "effective amount" used interchangeably herein, refers to an amount effective, at dosages and for periods of time necessary, to achieve a desired therapeutic result. A therapeutically effective amount may vary according to factors such as the disease state, age, sex, and weight of the individual, and the ability of a therapeutic or a combination of therapeutics to elicit a desired response in the individual. Example indicators of an effective therapeutic or combination of therapeutics that include, for example, improved wellbeing of the patient, reduction of a tumor burden, arrested or slowed growth of a tumor, and/or absence of metastasis of cancer cells to other locations in the body.

"Transduction" refers to the introduction of a foreign nucleic acid into a cell using a viral vector.

"Treat," "treating" or "treatment" of a disease or disorder such as cancer refers to accomplishing one or more of the following: reducing the severity and/or duration of the disorder, inhibiting worsening of symptoms characteristic of the disorder being treated, limiting or preventing recurrence of the disorder in subjects that have previously had the disorder, or limiting or preventing recurrence of symptoms in subjects that were previously symptomatic for the disorder.

"Tumor cell" or a "cancer cell" refers to a cancerous, pre-cancerous or transformed cell, either in vivo, ex vivo, or in tissue culture, that has spontaneous or induced phenotypic changes. These changes do not necessarily involve the uptake of new genetic material. Although transformation may arise from infection with a transforming virus and incorporation of new genomic nucleic acid, uptake of exogenous nucleic acid or it can also arise spontaneously or following exposure to a carcinogen, thereby mutating an endogenous gene. Transformation/cancer is exemplified by morphological changes, immortalization of cells, aberrant growth control, foci formation, proliferation, malignancy, modulation of tumor specific marker levels, invasiveness, tumor growth in suitable animal hosts such as nude mice, and the like, in vitro, in vivo, and ex vivo.

"Variant," "mutant" or "altered" refers to a polypeptide or a polynucleotide that differs from a reference polypeptide or a reference polynucleotide by one or more modifications, for example one or more substitutions, insertions or deletions.

The numbering of amino acid residues in the antibody constant region throughout the specification is according to the EU index as described in Kabat et al., Sequences of Proteins of Immunological Interest, 5th Ed. Public Health Service, National Institutes of Health, Bethesda, Md. (1991), unless otherwise explicitly stated.

Mutations in the Ig constant regions are referred to as follows: L351Y_F405A_Y407V refers to L351Y, F405A and Y407V mutations in one immunoglobulin constant region. L351Y_F405A_Y407V/T394W refers to L351Y, F405A and Y407V mutations in the first Ig constant region and T394W mutation in the second Ig constant region, which are present in one multimeric protein.

"VHH" refers to a single-domain antibody or nanobody, exclusively composed of the antigen binding domain of a heavy chain. A VHH single domain antibody lacks the light chain and the CH1 domain of the heavy chain of conventional Fab region.

Compositions of Matter
Antigen Binding Domains that Bind hK2
The disclosure provides antigen binding domains that bind hK2, monospecific and multispecific proteins (particularly bispecific proteins) comprising the antigen binding domains that bind hK2, chimeric antigen receptors (CAR) comprising the antigen binding domains that bind hK2, polynucleotides encoding the foregoing, vectors, host cells and methods of making and using the foregoing. The antigen binding domains that bind hK2 identified herein demonstrated improved properties in terms of improved thermostability. The multispecific proteins disclosed herein may be particularly effective at mediating T cell mediated cytotoxicity, promoting T cell activation and proliferation, increasing T cell cytokine release and/or displaying increased anti-tumor efficacy.

The disclosure provides an isolated protein comprising an antigen binding domain that binds kallikrein related peptidase 2 (hK2), wherein the antigen binding domain that binds hK2 binds to an epitope on hK2 set forth in SEQ ID NO: 111, 112, 113, 114, or 115.

In a particular embodiment, the antigen binding domain that binds hK2 binds to an epitope on hK2 set forth in SEQ ID NOs: 111 and 112.

In some embodiments, the antigen binding domain that binds hK2 binds to an epitope on hK2 set forth in SEQ ID NOs: 113, 114 and 115.

The invention also provides an isolated protein comprising an antigen binding domain that binds hK2, wherein the antibody or the antigen binding fragment thereof binds within residues KVTEF (SEQ ID NO: 111) or HYRKW (SEQ ID NO: 112) or SHGWAH (SEQ ID NO: 113) or RHNLFEPEDTGQRVP (SEQ ID NO: 114) or GWGSIEPEE (SEQ ID NO: 115) of hK2. In a particular embodiment, the invention also provides an isolated protein comprising an antigen binding domain that binds hK2, wherein said antigen binding domain binds to hK2 within epitopes having sequences of KVTEF (SEQ ID NO: 111) and HYRKW (SEQ ID NO: 112).

An H/D exchange assay may be used to determine the residues within hK2 to which an antibody binds. In an H/D exchange assay, recombinantly expressed soluble hK2 is incubated in the presence or absence of the antibody in deuterated water for predetermined times resulting in deuterium incorporation at exchangeable hydrogen atoms which are unprotected by the antibody, followed by protease digestion of the protein and analyses of the peptide fragments using LC-MS. H/D exchange assay can be performed using known protocols. An exemplary protocol is described in Example 3. In some embodiments, the H/D exchange mixture is quenched by the addition of a quenching buffer (e.g. 8 M urea, 1M TCEP, pH 3.0) before being passed over an equilibrated immobilized pepsin/FPXIII column at room temperature (e.g. 600 µL/min). The peptic fragments are then loaded onto a reverse phase trap column (e.g. at 600 µL/min) and desalted (e.g. for 1 min at 600 µL), separated (e.g. on a C18 column) and analyzed by mass spectrometry (e.g. using an LTQ™ Orbitrap Fusion Lumos mass spectrometer (Thermo Fisher Scientific) with the capillary temperature at 275° C., resolution 150,000, and mass range (m/z) 300-1,800).

The invention also provides an isolated protein comprising an antigen binding domain, wherein the antigen binding domain of said reference antibody binds to an epitope on hK2 having a sequence selected from the group consisting of SEQ ID NO: 111, 112, 113, 114, and 115 and wherein the antigen binding domain that binds hK2 competes for binding to hK2 with a reference antibody disclosed herein. In some embodiments, the reference antibody comprises:

a. the HCDR1, the HCDR2 and the HCDR3 of the VH of SEQ ID NO: 137 and the LCDR1, the LCDR2 and the LCDR3 of the VL of SEQ ID NO: 138; or
b. the HCDR1 the HCDR2 and the HCDR3 of the VH of SEQ ID NO: 162 and the LCDR1, the LCDR2 and the LCDR3 of the VL of SEQ ID NO: 163; or
c. the HCDR1, the HCDR2 and the HCDR3 of the VH of SEQ ID NO: 164 and the LCDR1, the LCDR2 and the LCDR3 of the VL of SEQ ID NO: 165; or
d. the HCDR1, the HCDR2 and the HCDR3 of the VH of SEQ ID NO: 166 and the LCDR1, the LCDR2 and the LCDR3 of the VL of SEQ ID NO: 167; or
e. the HCDR1, the HCDR2 and the HCDR3 of the VH of SEQ ID NO: 168 and the LCDR1, the LCDR2 and the LCDR3 of the VL of SEQ ID NO: 169; or
f. the HCDR1, the HCDR2 and the HCDR3 of the VH of SEQ ID NO: 204 and the LCDR1, the LCDR2 and the LCDR3 of the VL of SEQ ID NO: 205; or
g. the HCDR1, the HCDR2 and the HCDR3 of the VH of SEQ ID NO: 166 and the LCDR1, the LCDR2 and the LCDR3 of the VL of SEQ ID NO: 444.

In certain such embodiments, the reference antibody comprises a heavy chain complementarity determining region (HCDR) 1, a HCDR2 and a HCDR3 of a heavy chain variable region (VH) of SEQ ID NO: 162 and a light chain complementarity determining region (LCDR) 1, a LCDR2 and a LCDR3 of a light chain variable region (VL) of SEQ ID NO: 163.

Competition for binding of a test antibody that binds to SEQ ID NO: 111, 112, 113, 114, or 115 of soluble hK2 with the reference antibodies of the invention may be assayed in vitro using well known methods. For example, binding of labeled antibody to hK2 the membrane proximal region of hK2 in the presence of an unlabeled reference antibody may be assessed by ELISA, or Bioacore analyses or flow cytometry may be used to demonstrate competition. The test antibody competes for binding to hk2 with the reference antibody when the test antibody inhibits binding of the reference antibody to soluble hK2 by 85% or more, for example 90% or more, or 95% or more.

The disclosure provides an isolated protein comprising an antigen binding domain that binds kallikrein related peptidase 2 (hK2), wherein the antigen binding domain that binds hK2 comprises a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or the HCDR1, the HCDR2 and the HCDR3 of the VH of SEQ ID NO: 137 and the LCDR1, the LCDR2 and the LCDR3 of the VL of SEQ ID NO: 138 or the HCDR1, the HCDR2 and the HCDR3 of the VH of SEQ ID NO: 162 and the LCDR1, the LCDR2 and the LCDR3 of the VL of SEQ ID NO: 163; or the HCDR, the HCDR2 and the HCDR3 of the VH of SEQ ID NO: 164 and the LCDR1, the LCDR2 and the LCDR3 of the VL of SEQ ID NO: 165; or the HCDR1, the HCDR2 and the HCDR3 of the VH of SEQ ID NO: 166 and the LCDR1, the LCDR2 and the LCDR3 of the VL of SEQ ID NO: 167; or the HCDR1, the HCDR2 and the HCDR3 of the VH of SEQ ID NO: 168 and the LCDR1, the LCDR2 and the LCDR3 of the VL of SEQ ID NO: 169; or the HCDR1, the HCDR2 and the HCDR3 of the VH of SEQ ID NO: 204 and the LCDR1, the LCDR2 and the LCDR3 of the VL of SEQ ID NO: 205. In a particular embodiment, the isolated protein comprising an antigen binding domain that binds kallikrein related peptidase 2 (hK2), wherein the antigen binding domain that binds hK2 comprises the HCDR1, the HCDR2 and the HCDR3 of the VH of SEQ ID NO: 162 and the LCDR1, the LCDR2 and the LCDR3 of the VL of SEQ ID NO: 163.

The disclosure provides an isolated protein comprising an antigen binding domain that binds hK2, wherein the antigen binding domain that binds hK2 comprises the HCDR1, the HCDR1, the HCDR3, the LCDR1, the LCDR2 and the LCDR3 of
SEQ ID NOs: 63, 65, 66, 67, 69, 71, respectively;
SEQ ID NOs: 63, 65, 66, 68, 70, 71, respectively;
SEQ ID NOs: 72, 73, 66, 67, 69, 71, respectively;
SEQ ID NOs: 141, 142, 143, 144, 145 and 146, respectively;
SEQ ID NOs: 170, 171, 172, 173, 174 and 175, respectively;
SEQ ID NOs: 176, 177, 178, 179, 180 and 181, respectively.
SEQ ID NOs: 170, 183, 184, 185, 186, and 187, respectively;
SEQ ID NOs: 188, 189, 190, 191, 192, and 193, respectively;
SEQ ID NOs: 206, 207, 208, 182, 470, 209, respectively;
SEQ ID NOs: 147, 148, 143, 144, 145 and 146, respectively;
SEQ ID NOs: 194, 195, 172, 173, 174, and 175, respectively;
SEQ ID NOs: 196, 197, 178, 179, 180, 181, respectively;
SEQ ID NOs: 198, 199, 184, 185, 186, and 187, respectively;
SEQ ID NOs: 200, 201, 190, 191, 192, and 193, respectively; or
SEQ ID NOs: 216, 217, 218, 182, 470, and 209, respectively.

In a particular embodiment, the disclosure provides an isolated protein comprising an antigen binding domain that binds hK2, wherein the antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively.

In another particular embodiment, the disclosure provides an isolated protein comprising an antigen binding domain that binds hK2, wherein the antigen binding domain that binds hK2 comprises the HCDR1, the HCDR1, the HCDR3, the LCDR1, the LCDR2 and the LCDR3 of SEQ ID NOs: of SEQ ID NOs: 194, 195, 172, 173, 174, and 175, respectively.

The disclosure provides an isolated protein comprising an antigen binding domain that binds hK2, wherein the antigen binding domain that binds hK2 comprises the VH of SEQ ID NOs: 137, 162, 164, 166, 168 or 204 and the VL of SEQ ID NOs: 138, 163, 165, 167 or 169.

The disclosure provides an isolated protein comprising an antigen binding domain that binds hK2, wherein the antigen binding domain that binds hK2 comprises
the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169; or
the VH of SEQ ID NO: 204 and the VL of SEQ ID NO: 205.

In a particular embodiment, the disclosure provides an isolated protein comprising an antigen binding domain that binds hK2, wherein the antigen binding domain that binds hK2 comprises a VH of SEQ ID NO: 162 and a VL of SEQ ID NO: 163.

The disclosure also provides an isolated protein comprising an antigen binding domain that binds hK2, wherein the antigen binding domain that binds hK2 comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163.

In some embodiments, the antigen binding domain that binds hK2 comprises a VH which is at least 80% (e.g. at least 85%, at least 90%, at least 95% or at least 99%) identical to the VH of SEQ ID NO: 162 and a VL of SEQ ID NO: 163.

In some embodiments, the antigen binding domain that binds hK2 comprises a VH of SEQ ID NO: 162 and a VL which is at least 80% (e.g. at least 85%, at least 90%, at least 95% or at least 99%) identical to the VL of SEQ ID NO: 163.

In some embodiments, the antigen binding domain that binds hK2 comprises a VH which is at least 95% identical to the VH of SEQ ID NO: 162 and a VL which is at least 95% identical to the VL of SEQ ID NO: 163.

In some embodiments, the antigen binding domain that binds hK2 comprises a VH which is at least 95% identical to the VH of SEQ ID NO: 162 and a VL which is at least 99% identical to the VL of SEQ ID NO: 163.

In some embodiments, the antigen binding domain that binds hK2 comprises a VH which is at least 99% identical to the VH of SEQ ID NO: 162 and a VL which is at least 99% identical to the VL of SEQ ID NO: 163.

In some embodiments, the antigen binding domain that binds hK2 comprises a VH which is at least 99% identical to the VH of SEQ ID NO: 162 and a VL which is at least 95% identical to the VL of SEQ ID NO: 163.

The disclosure provides an isolated protein comprising an antigen binding domain that binds hK2, wherein the antigen binding domain that binds hK2 comprises the amino acid sequence of SEQ ID NOs: 133, 134, 308, 316, 324, 325, 404, 405, 406, 407, 408, or 409. In a particular embodiment, the disclosure provides an isolated protein comprising an antigen binding domain that binds hK2, wherein the antigen binding domain that binds hK2 comprises the amino acid sequence of SEQ ID NO: 404.

In another embodiment, the disclosure provides an isolated protein comprising an antigen binding domain that binds hK2, wherein the antigen binding domain that binds hK2 comprises the amino acid sequence of SEQ ID NO: 405.

The disclosure also provides an isolated protein comprising an antigen binding domain that binds hK2, wherein the antigen binding domain that binds hK2 comprises an amino acid sequence at least 80% (e.g. at least 85%, at least 90%, at least 95% or at least 99%) identical to the amino acid sequence of SEQ ID NO: 404.

The disclosure also provides an isolated protein comprising an antigen binding domain that binds hK2, wherein the antigen binding domain that binds hK2 comprises an amino acid sequence at least 80% (e.g. at least 85%, at least 90%, at least 95% or at least 99%) identical to the amino acid sequence of SEQ ID NO: 405.

The disclosure also provides an isolated protein comprising an antigen binding domain that binds kallikrein related peptidase 2 (hK2), wherein the antigen binding domain that binds hK2 comprises a heavy chain variable region (VH) of SEQ ID NO: 75 and a light chain variable region (VL) of SEQ ID NO: 74. SEQ ID NO: 75 and SEQ ID NO: 74 represent genus VH and VL amino acid sequences encompassing variants demonstrating improved thermostability when compared to the parent antibody hu11B6. The positions engineered which conferred improved thermostability were residues P41, I49, M70, and A88 in the VH (residue numbering according to the hu11B6_VH of SEQ ID NO: 5) and S80, L82, A88 and Y91 in the VL (residue numbering according to the hu11B6_VL of SEQ ID NO: 2).

```
(VH consensus sequence)
                                                   SEQ ID NO: 75
QVQLQESGPGLVKPSX₁TLSLTCX₂VSGNSITSDYAWNWIRQX₃PGKX₄

LEWX₅GYISYSGSTTYNPSLKSRVTX₆SRDTSKNQFSLKLSSVTX₇X₈D

TAVYYCATGYYYGSGFWGQGTLVTVSS (VL consensus sequence)
                                                   SEQ ID NO: 74
X₁IVLTQSPX₂X₃LX₄X₅SX₆GERATX₇X₈CX₉ASESVEYFGTSLMHWY

QQKPGQPPX₁₀LLIYAASNX₁₁ESGX₁₂PX₁₃RFSGSGSGTDFTLTIX₁₄

SX₁₅X₁₆QX₁₇EDX₁₈X₁₉VYX₂₀CQQTRKVPYTFGX₂₁GTKX₂₂EIK
```

The disclosure provides an isolated protein comprising an antigen binding domain that binds hK2, wherein the antigen binding domain that binds hK2 comprises the VH of SEQ ID NOs: 4, 5, 6, 139, 159 or 161 and the VL of SEQ ID NOs: 1, 2, 3, 140 or 160, with the proviso that the antigen binding domain that binds hK2 does not comprise the VH of SEQ ID NO: 5 and the VL of SEQ ID NO: 2.

The disclosure also provides an isolated protein comprising an antigen binding domain that binds hK2, wherein the antigen binding domain that binds hK2 comprises
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 4 and the VL of SEQ ID NO: 140;
the VH of SEQ ID NO: 4 and the VL of SEQ ID NO: 160;
the VH of SEQ ID NO: 5 and the VL of SEQ ID NO: 1;
the VH of SEQ ID NO: 5 and the VL of SEQ ID NO: 3;
the VH of SEQ ID NO: 5 and the VL of SEQ ID NO: 140;
the VH of SEQ ID NO: 5 and the VL of SEQ ID NO: 160;
the VH of SEQ ID NO: 6 and the VL of SEQ ID NO: 1;
the VH of SEQ ID NO: 6 and the VL of SEQ ID NO: 2;
the VH of SEQ ID NO: 6 and the VL of SEQ ID NO: 3;
the VH of SEQ ID NO: 6 and the VL of SEQ ID NO: 140;
the VH of SEQ ID NO: 6 and the VL of SEQ ID NO: 160;
the VH of SEQ ID NO: 139 and the VL of SEQ ID NO: 1;
the VH of SEQ ID NO: 139 and the VL of SEQ ID NO: 2;
the VH of SEQ ID NO: 139 and the VL of SEQ ID NO: 3;
the VH of SEQ ID NO: 139 and the VL of SEQ ID NO: 140;
the VH of SEQ ID NO: 139 and the VL of SEQ ID NO: 160;
the VH of SEQ ID NO: 159 and the VL of SEQ ID NO: 1;
the VH of SEQ ID NO: 159 and the VL of SEQ ID NO: 2;
the VH of SEQ ID NO: 159 and the VL of SEQ ID NO: 3;
the VH of SEQ ID NO: 159 and the VL of SEQ ID NO: 140;
the VH of SEQ ID NO: 159 and the VL of SEQ ID NO: 160;
the VH of SEQ ID NO: 161 and the VL of SEQ ID NO: 1;
the VH of SEQ ID NO: 161 and the VL of SEQ ID NO: 2;
the VH of SEQ ID NO: 161 and the VL of SEQ ID NO: 3;
the VH of SEQ ID NO: 161 and the VL of SEQ ID NO: 140;
or
the VH of SEQ ID NO: 161 and the VL of SEQ ID NO: 160.

The disclosure also provides an isolated protein comprising an antigen binding domain that binds hK2, wherein the antigen binding domain that binds hK2 comprises the amino acid sequence of SEQ ID NOs: 8, 9, 10, 11, 12, 13, 14, 15, 16, 17, 18, 19, 20, 21, 22, 23, 135, 136, 318, 319, 320, 321, 322 or 323.

In some embodiments, the antigen binding domain that binds hK2 is a scFv.

In some embodiments, the antigen binding domain that binds hK2 is a (scFv)₂.

In some embodiments, the antigen binding domain that binds hK2 is a Fv.

In some embodiments, the antigen binding domain that binds hK2 is a Fab.

In some embodiments, the antigen binding domain that binds hK2 is a F(ab')₂.

In some embodiments, the antigen binding domain that binds hK2 is a Fd.

In some embodiments, the hK2 antigen binding domain is a dAb.

In some embodiments, the hK2 antigen binding domain is a VHH.

In a particular embodiment, the antigen binding domain that binds hK2 is a Fab.

hK2 Binding scFvs

Any of the VH and the VL domains identified herein that bind hK2 may be engineered into scFv format in either VH-linker-VL or VL-linker-VH orientation. Any of the VH and the VL domains identified herein may also be used to generate sc(Fv)₂ structures, such as VH-linker-VL-linker-VL-linker-VH, VH-linker-VL-linker-VH-linker-VL. VH-linker-VH-linker-VL-linker-VL. VL-linker-VH-linker-VH-linker-VL. VL-linker-VH-linker-VL-linker-VH or VL-linker-VL-linker-VH-linker-VH.

The VH and the VL domains identified herein may be incorporated into a scFv format and the binding and thermostability of the resulting scFv to hK2 may be assessed using known methods. Binding may be assessed using ProteOn XPR36, BIAcore 3000 or KinExA instrumentation, ELISA or competitive binding assays known to those skilled in the art. Binding may be evaluated using purified scFvs or *E coli* supernatants or lysed cells containing the expressed scFv. The measured affinity of a test scFv to hK2 may vary if measured under different conditions (e.g., osmolarity, pH). Thus, measurements of affinity and other binding parameters (e.g., $K_D$, $K_{on}$, $K_{off}$) are typically made with standardized conditions and standardized buffers. Thermostability may be evaluated by heating the test scFv at elevated temperatures, such as at 50° C., 55° C. or 60° C. for a period of time, such as 5 minutes (min), 10 min, 15 min, 20 min, 25 min or 30 min and measuring binding of the test scFv to hK2. The scFvs retaining comparable binding to hK2 when compared to a non-heated scFv sample are referred to as being thermostable.

In recombinant expression systems, the linker is a peptide linker and may include any naturally occurring amino acid. Exemplary amino acids that may be included into the linker are Gly, Ser Pro, Thr, Glu, Lys, Arg, Ile, Leu, His and The. The linker should have a length that is adequate to link the VH and the VL in such a way that they form the correct conformation relative to one another so that they retain the desired activity, such as binding to hK2.

The linker may be about 5-50 amino acids long. In some embodiments, the linker is about 10-40 amino acids long. In some embodiments, the linker is about 10-35 amino acids long. In some embodiments, the linker is about 10-30 amino acids long. In some embodiments, the linker is about 10-25 amino acids long. In some embodiments, the linker is about 10-20 amino acids long. In some embodiments, the linker is about 15-20 amino acids long. In some embodiments, the linker is 6 amino acids long. In some embodiments, the linker is 7 amino acids long. In some embodiments, the linker is 8 amino acids long. In some embodiments, the linker is 9 amino acids long. In some embodiments, the linker is 10 amino acids long. In some embodiments, the linker is 11 amino acids long. In some embodiments, the linker is 12 amino acids long. In some embodiments, the linker is 13 amino acids long. In some embodiments, the linker is 14 amino acids long. In some embodiments, the linker is 15 amino acids long. In some embodiments, the linker is 16 amino acids long. In some embodiments, the linker is 17 amino acids long. In some embodiments, the linker is 18 amino acids long. In some embodiments, the linker is 19 amino acids long. In some embodiments, the linker is 20 amino acids long. In some embodiments, the linker is 21 amino acids long. In some embodiments, the linker is 22 amino acids long. In some embodiments, the linker is 23 amino acids long. In some embodiments, the linker is 24 amino acids long. In some embodiments, the linker is 25 amino acids long. In some embodiments, the linker is 26 amino acids long. In some embodiments, the linker is 27 amino acids long. In some embodiments, the linker is 28 amino acids long. In some embodiments, the linker is 29 amino acids long. In some embodiments, the linker is 30 amino acids long. In some embodiments, the linker is 31 amino acids long. In some embodiments, the linker is 32 amino acids long. In some embodiments, the linker is 33 amino acids long. In some embodiments, the linker is 34 amino acids long. In some embodiments, the linker is 35 amino acids long. In some embodiments, the linker is 36 amino acids long. In some embodiments, the linker is 37 amino acids long. In some embodiments, the linker is 38 amino acids long. In some embodiments, the linker is 39 amino acids long. In some embodiments, the linker is 40 amino acids long. Exemplary linkers that may be used are Gly rich linkers, Gly and Ser containing linkers, Gly and Ala containing linkers, Ala and Ser containing linkers, and other flexible linkers.

Other linker sequences may include portions of immunoglobulin hinge area CL or CH1 derived from any immunoglobulin heavy or light chain isotype. Alternatively, a variety of non-proteinaceous polymers, including polyethylene glycol (PEG), polypropylene glycol, polyoxyalkylenes, or copolymers of polyethylene glycol and polypropylene glycol, may find use as linkers. Exemplary linkers that may be used are shown in Table 1. Additional linkers are described for example in Int. Pat. Publ. No. WO2019/060695.

In some embodiments, the scFv comprises, from the N- to C-terminus, a VH, a first linker (L1) and a VL (VH-L1-VL).

In some embodiments, the scFv comprises, from the N- to C-terminus, the VL, the L1 and the VH (VL-L1-VH).

In some embodiments, the L1 comprises the amino acid sequence of SEQ ID NO: 7.

In some embodiments, the L1 comprises the amino acid sequence of SEQ ID NO: 76.

In some embodiments, the L1 comprises the amino acid sequence of SEQ ID NO: 77.

In some embodiments, the L1 comprises the amino acid sequence of SEQ ID NO: 78.

In some embodiments, the L1 comprises the amino acid sequence of SEQ ID NO: 79.

In some embodiments, the L1 comprises the amino acid sequence of SEQ ID NO: 80.

In some embodiments, the L1 comprises the amino acid sequence of SEQ ID NO: 81.

In some embodiments, the L1 comprises the amino acid sequence of SEQ ID NO: 82.

In some embodiments, the L1 comprises the amino acid sequence of SEQ ID NO: 83.

In some embodiments, the L1 comprises the amino acid sequence of SEQ ID NO: 84.

In some embodiments, the L1 comprises the amino acid sequence of SEQ ID NO: 85.

In some embodiments, the L1 comprises the amino acid sequence of SEQ ID NO: 86.

In some embodiments, the L1 comprises the amino acid sequence of SEQ ID NO: 87.

In some embodiments, the L1 comprises the amino acid sequence of SEQ ID NO: 88.

In some embodiments, the L1 comprises the amino acid sequence of SEQ ID NO: 89.

In some embodiments, the L1 comprises the amino acid sequence of SEQ ID NO: 90.

In some embodiments, the L1 comprises the amino acid sequence of SEQ ID NO: 91.

In some embodiments, the L1 comprises the amino acid sequence of SEQ ID NO: 92.

In some embodiments, the L1 comprises the amino acid sequence of SEQ ID NO: 93.

In some embodiments, the L1 comprises the amino acid sequence of SEQ ID NO: 94.

In some embodiments, the L1 comprises the amino acid sequence of SEQ ID NO: 95.

In some embodiments, the L1 comprises the amino acid sequence of SEQ ID NO: 96.

In some embodiments, the L1 comprises the amino acid sequence of SEQ ID NO: 97.

In some embodiments, the L1 comprises the amino acid sequence of SEQ ID NO: 98.
In some embodiments, the L1 comprises the amino acid sequence of SEQ ID NO: 99.
In some embodiments, the L1 comprises the amino acid sequence of SEQ ID NO: 100.
In some embodiments, the L1 comprises the amino acid sequence of SEQ ID NO: 101.
In some embodiments, the L1 comprises the amino acid sequence of SEQ ID NO: 102.
In some embodiments, the L1 comprises the amino acid sequence of SEQ ID NO: 103.
In some embodiments, the L1 comprises the amino acid sequence of SEQ ID NO: 104.
In some embodiments, the L1 comprises the amino acid sequence of SEQ ID NO: 105.
In some embodiments, the L1 comprises the amino acid sequence of SEQ ID NO: 106.
In some embodiments, the L1 comprises the amino acid sequence of SEQ ID NO: 107
In some embodiments, the L1 comprises the amino acid sequence of SEQ ID NO: 108.

TABLE 1

| Linker name | Amino acid sequence | SEQ ID NO: |
| --- | --- | --- |
| Linker 1 | GGSEGKSSGSGSESKSTGGS | 7 |
| Linker 2 | GGGSGGGS | 76 |
| Linker 3 | GGGSGGGSGGGS | 77 |
| Linker 4 | GGGSGGGSGGGSGGGS | 78 |
| Linker 5 | GGGSGGGSGGGSGGGSGGGS | 79 |
| Linker 6 | GGGGSGGGGSGGGGS | 80 |
| Linker 7 | GGGGSGGGGSGGGGSGGGGS | 81 |
| Linker 8 | GGGGSGGGGSGGGGSGGGGSGGGGS | 82 |
| Linker 9 | GSTSGSGKPGSGEGSTKG | 83 |
| Linker 10 | IRPRAIGGSKPRVA | 84 |
| Linker 11 | GKGGSGKGGSGKGGS | 85 |
| Linker 12 | GGKGSGGKGSGGKGS | 86 |
| Linker 13 | GGGKSGGGKSGGGKS | 87 |
| Linker 14 | GKGKSGKGKSGKGKS | 88 |
| Linker 15 | GGGKSGGKGSGKGGS | 89 |
| Linker 16 | GKPGSGKPGSGKPGS | 90 |
| Linker 17 | GKPGSGKPGSGKPGSGKPGS | 91 |
| Linker 18 | GKGKSGKGKSGKGKSGKGKS | 92 |
| Linker 19 | STAGDTHLGGEDFD | 93 |
| Linker 20 | GEGGSGEGGSGEGGS | 94 |
| Linker 21 | GGEGSGGEGSGGEGS | 95 |
| Linker 22 | GEGESGEGESGEGES | 96 |
| Linker 23 | GGGESGGEGSGEGGS | 97 |
| Linker 24 | GEGESGEGESGEGESGEGES | 98 |
| Linker 25 | GSTSGSGKPGSGEGSTKG | 99 |

TABLE 1-continued

| Linker name | Amino acid sequence | SEQ ID NO: |
| --- | --- | --- |
| Linker 26 | PRGASKSGSASQTGSAPGS | 100 |
| Linker 27 | GTAAAGAGAAGGAAAGAAG | 101 |
| Linker 28 | GTSGSSGSGSGGSGSGGGG | 102 |
| Linker 29 | GKPGSGKPGSGKPGSGKPGS | 103 |
| Linker 30 | GSGS | 104 |
| Linker 31 | APAPAPAPAP | 105 |
| Linker 32 | APAPAPAPAPAPAPAPAP | 106 |
| Linker 33 | AEAAAKEAAAKEAAAAKEAAAAKEAAAAKAAA | 107 |
| Linker 34 | GTEGKSSGSGSESKST | 108 |

In a particular embodiment, the L1 comprises or consists of the amino acid sequence of SEQ ID NO: 7.

In some embodiments, the scFv comprises a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or the HCDR1, the HCDR2 and the HCDR3 of the VH of SEQ ID NO: 162 and the LCDR1, the LCDR2 and the LCDR3 of the VL of SEQ ID NO: 163; or the HCDR1, the HCDR2 and the HCDR3 of the VH of SEQ ID NO: 164 and the LCDR1, the LCDR2 and the LCDR3 of the VL of SEQ ID NO: 165; or the HCDR1, the HCDR2 and the HCDR3 of the VH of SEQ ID NO: 166 and the LCDR1, the LCDR2 and the LCDR3 of the VL of SEQ ID NO: 167; or the HCDR1, the HCDR2 and the HCDR3 of the VH of SEQ ID NO: 168 and the LCDR1, the LCDR2 and the LCDR3 of the VL of SEQ ID NO: 169; or the HCDR1, the HCDR2 and the HCDR3 of the VH of SEQ ID NO: 204 and the LCDR1, the LCDR2 and the LCDR3 of the VL of SEQ ID NO: 205; or the HCDR1, the HCDR2 and the HCDR3 of the VH of SEQ ID NO: 139 and the LCDR1, the LCDR2 and the LCDR3 of the VL of SEQ ID NO: 140.

In some embodiments, the scFv comprises the HCDR1, the HCDR1, the HCDR3, the LCDR1, the LCDR2 and the LCDR3 of
SEQ ID NOs: 63, 65, 66, 67, 69, 71, respectively;
SEQ ID NOs: 63, 65, 66, 68, 70, 71, respectively;
SEQ ID NOs: 72, 73, 66, 67, 69, 71, respectively;
SEQ ID NOs: 141, 142, 143, 144, 145 and 146, respectively;
SEQ ID NOs: 170, 171, 172, 173, 174 and 175, respectively;
SEQ ID NOs: 176, 177, 178, 179, 180 and 181, respectively;
SEQ ID NOs: 170, 183, 184, 185, 186, and 187, respectively;
SEQ ID NOs: 188, 189, 190, 191, 192, and 193, respectively;
SEQ ID NOs: 206, 207, 208, 182, 470, 209, respectively;
SEQ ID NOs: 147, 148, 143, 144, 145 and 146, respectively;
SEQ ID NOs: 194, 195, 172, 173, 174, and 175, respectively;
SEQ ID NOs: 196, 197, 178, 179, 180, 181, respectively;
SEQ ID NOs: 198, 199, 184, 185, 186, and 187, respectively;
SEQ ID NOs: 200, 201, 190, 191, 192, and 193, respectively; or SEQ ID NOs: 216, 217, 218, 182, 470, and 209, respectively.

In some embodiments, the scFv comprises the HCDR1, the HCDR1, the HCDR3, the LCDR1, the LCDR2 and the LCDR3 of SEQ ID NOs: 141, 142, 143, 144, 145 and 146, respectively.

In some embodiments, the scFv comprises the HCDR1, the HCDR1, the HCDR3, the LCDR1, the LCDR2 and the LCDR3 of SEQ ID NOs: 170, 171, 172, 173, 174 and 175, respectively.

In some embodiments, the scFv comprises the HCDR1, the HCDR1, the HCDR3, the LCDR1, the LCDR2 and the LCDR3 of SEQ ID NOs: 176, 177, 178, 179, 180 and 181, respectively.

In some embodiments, the scFv comprises the HCDR1, the HCDR1, the HCDR3, the LCDR1, the LCDR2 and the LCDR3 of SEQ ID NOs: 170, 183, 184, 185, 186, and 187, respectively.

In some embodiments, the scFv comprises the HCDR1, the HCDR1, the HCDR3, the LCDR1, the LCDR2 and the LCDR3 of SEQ ID NOs: 188, 189, 190, 182, 470, and 209, respectively.

In some embodiments, the scFv comprises the HCDR1, the HCDR1, the HCDR3, the LCDR1, the LCDR2 and the LCDR3 of SEQ ID NOs: 147, 148, 143, 144, 145 and 146, respectively.

In some embodiments, the scFv comprises the HCDR1, the HCDR1, the HCDR3, the LCDR1, the LCDR2 and the LCDR3 of SEQ ID NOs: 141, 142, 143, 144, 145 and 146, respectively.

In some embodiments, the scFv comprises the HCDR1, the HCDR1, the HCDR3, the LCDR1, the LCDR2 and the LCDR3 of SEQ ID NOs: 194, 195, 172, 173, 174, and 175, respectively.

In some embodiments, the scFv comprises the HCDR1, the HCDR1, the HCDR3, the LCDR1, the LCDR2 and the LCDR3 of SEQ ID NOs: 196, 197, 178, 179, 180, 181, respectively.

In some embodiments, the scFv comprises the HCDR1, the HCDR1, the HCDR3, the LCDR1, the LCDR2 and the LCDR3 of SEQ ID NOs: 198, 199, 184, 185, 186, and 187, respectively.

In some embodiments, the scFv comprises the HCDR1, the HCDR1, the HCDR3, the LCDR1, the LCDR2 and the LCDR3 of SEQ ID NOs: 200, 201, 190, 191, 192, and 193, respectively.

In some embodiments, the scFv comprises the HCDR1, the HCDR1, the HCDR3, the LCDR1, the LCDR2 and the LCDR3 of SEQ ID NOs: 216, 217, 218, 182, 470, and 209, respectively.

In some embodiments, the scFv comprises the HCDR1, the HCDR1, the HCDR3, the LCDR1, the LCDR2 and the LCDR3 of SEQ ID NOs: 63, 65, 66, 67, 69 and 71, respectively.

In some embodiments, the scFv comprises the HCDR1, the HCDR1, the HCDR3, the LCDR1, the LCDR2 and the LCDR3 of SEQ ID NOs: 63, 65, 66, 68, 70 and 71, respectively.

In some embodiments, the scFv comprises the HCDR1, the HCDR1, the HCDR3, the LCDR1, the LCDR2 and the LCDR3 of SEQ ID NOs: 72, 73, 66, 67, 69 and 71, respectively.

In some embodiments, the scFv comprises the VH of SEQ ID NO: 137 and the VL of SEQ ID NO: 138.

In some embodiments, the scFv comprises the VH of SEQ ID NO: 162 and the VL of SEQ ID NO: 163.

In some embodiments, the scFv comprises the VH of SEQ ID NO: 164 and the VL of SEQ ID NO: 165.

In some embodiments, the scFv comprises the VH of SEQ ID NO: 166 and the VL of SEQ ID NO: 167.

In some embodiments, the scFv comprises the VH of SEQ ID NO: 168 and the VL of SEQ ID NO: 169.

In some embodiments, the scFv comprises the VH of SEQ ID NO: 204 and the VL of SEQ ID NO: 205.

In some embodiments, the scFv comprises the VH of SEQ ID NO: 159 and the VL of SEQ ID NO: 160.

In some embodiments, the scFv comprises the VH of SEQ ID NO: 161 and the VL of SEQ ID NO: 140.

In some embodiments, the scFv comprises the VH of SEQ ID NO: 139 and the VL of SEQ ID NO: 140.

In some embodiments, the scFv comprises the VH of SEQ ID NO: 159 and the VL of SEQ ID NO: 140.

In some embodiments, the scFv comprises a VH which is at least 80% (e.g. at least 85%, at least 90%, at least 95% or at least 99%) identical to the VH of SEQ ID NO: 137 and a VL which is at least 80% (e.g. at least 85%, at least 90%, at least 95% or at least 99%) identical to the VL of SEQ ID NO: 138.

In some embodiments, the scFv comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163.

In some embodiments, the scFv comprises a VH which is at least 80% (e.g. at least 85%, at least 90%, at least 95% or at least 99%) identical to the VH of SEQ ID NO: 164 and a VL which is at least 80% (e.g. at least 85%, at least 90%, at least 95% or at least 99%) identical to the VL of SEQ ID NO: 165.

In some embodiments, the scFv comprises a VH which is at least 80% (e.g. at least 85%, at least 90%, at least 95% or at least 99%) identical to the VH of SEQ ID NO: 166 and a VL which is at least 80% (e.g. at least 85%, at least 90%, at least 95% or at least 99%) identical to the VL of SEQ ID NO: 167.

In some embodiments, the scFv comprises a VH which is at least 80% (e.g. at least 85%, at least 90%, at least 95% or at least 99%) identical to the VH of SEQ ID NO: 168 and a VL which is at least 80% (e.g. at least 85%, at least 90%, at least 95% or at least 99%) identical to the VL of SEQ ID NO: 169.

In some embodiments, the scFv comprises a VH which is at least 80% (e.g. at least 85%, at least 90%, at least 95% or at least 99%) identical to the VH of SEQ ID NO: 204 and a VL which is at least 80% (e.g. at least 85%, at least 90%, at least 95% or at least 99%) identical to the VL of SEQ ID NO: 205.

In some embodiments, the scFv comprises a VH which is at least 80% (e.g. at least 85%, at least 90%, at least 95% or at least 99%) identical to the VH of SEQ ID NO: 159 and a VL which is at least 80% (e.g. at least 85%, at least 90%, at least 95% or at least 99%) identical to the VL of SEQ ID NO: 160.

In some embodiments, the scFv comprises a VH which is at least 80% (e.g. at least 85%, at least 90%, at least 95% or at least 99%) identical to the VH of SEQ ID NO: 161 and a VL which is at least 80% (e.g. at least 85%, at least 90%, at least 95% or at least 99%) identical to the VL of SEQ ID NO: 140.

In some embodiments, the scFv comprises a VH which is at least 80% (e.g. at least 85%, at least 90%, at least 95% or at least 99%) identical to the VH of SEQ ID NO: 139 and a VL which is at least 80% (e.g. at least 85%, at least 90%, at least 95% or at least 99%) identical to the VL of SEQ ID NO: 140.

In some embodiments, the scFv comprises a VH which is at least 80% (e.g. at least 85%, at least 90%, at least 95% or at least 99%) identical to the VH of SEQ ID NO: 159 and a VL which is at least 80% (e.g. at least 85%, at least 90%, at least 95% or at least 99%) identical to the VL of SEQ ID NO: 140.

In some embodiments, the scFv comprises a VH which is at least 80% (e.g. at least 85%, at least 90%, at least 95% or at least 99%) identical to the VH of SEQ ID NO: 162 and a VL of SEQ ID NO: 163.

In some embodiments, the scFv comprises a VH of SEQ ID NO: 162 and a VL which is at least 80% (e.g. at least 85%, at least 90%, at least 95% or at least 99%) identical to the VL of SEQ ID NO: 163.

In some embodiments, the scFv comprises a VH which is at least 95% identical to the VH of SEQ ID NO: 162 and a VL which is at least 95% identical to the VL of SEQ ID NO: 163.

In some embodiments, the scFv comprises a VH which is at least 99% identical to the VH of SEQ ID NO: 162 and a VL which is at least 95% identical to the VL of SEQ ID NO: 163.

In some embodiments, the scFv comprises a VH which is at least 99% identical to the VH of SEQ ID NO: 162 and a VL which is at least 99% identical to the VL of SEQ ID NO: 163.

In some embodiments, the scFv comprises a VH which is at least 95% identical to the VH of SEQ ID NO: 162 and a VL which is at least 99% identical to the VL of SEQ ID NO: 163.

In some embodiments, the scFv comprises the amino acid sequence of SEQ ID NOs: 133, 134, 308, 316, 324, 325, 404, 405, 406, 407, 408, or 409.

In some embodiments, the scFv comprises an amino acid sequence which is at least 80% (e.g. at least 85%, at least 90%, at least 95% or at least 99%) identical to the amino acid sequence of SEQ ID NO: 133, 134, 308, 316, 324, 325, 404, 405, 406, 407, 408, or 409.

In some embodiments, the scFv comprises an amino acid sequence which is at least 80% (e.g. at least 85%, at least 90%, at least 95% or at least 99%) identical to the amino acid sequence of SEQ ID NO: 404.

In some embodiments, the scFv comprises an amino acid sequence which is at least 80% (e.g. at least 85%, at least 90%, at least 95% or at least 99%) identical to the amino acid sequence of SEQ ID NO: 405.

In some embodiments, the scFv comprises the VH of SEQ ID NO: 75 and the VL of SEQ ID NO: 74.

In some embodiments, the scFv comprises the VH of SEQ ID NOs: 4, 5 or 6 and the VL of SEQ ID NOs: 1, 2 or 3.

In some embodiments, the scFv comprises the VH of SEQ ID NOs: 4, 5, 6, 139, 159 or 161 and the VL of SEQ ID NOs: 1, 2, 3, 140 or 160, with the proviso that the antigen binding domain that binds hK2 does not comprise the VH of SEQ ID NO: 5 and the VL of SEQ ID NO: 2.

In some embodiments, the scFv comprises the VH of SEQ ID NO: 4 and the VL of SEQ ID NO: 1.

In some embodiments, the scFv comprises the VH of SEQ ID NO: 4 and the VL of SEQ ID NO: 2.

In some embodiments, the scFv comprises the VH of SEQ ID NO: 4 and the VL of SEQ ID NO: 3.

In some embodiments, the scFv comprises the VH of SEQ ID NO: 4 and the VL of SEQ ID NO: 140.

In some embodiments, the scFv comprises the VH of SEQ ID NO: 4 and the VL of SEQ ID NO: 160.

In some embodiments, the scFv comprises the VH of SEQ ID NO: 5 and the VL of SEQ ID NO: 1.

In some embodiments, the scFv comprises the VH of SEQ ID NO: 5 and the VL of SEQ ID NO: 3.

In some embodiments, the scFv comprises the VH of SEQ ID NO: 5 and the VL of SEQ ID NO: 140.

In some embodiments, the scFv comprises the VH of SEQ ID NO: 5 and the VL of SEQ ID NO: 160.

In some embodiments, the scFv comprises the VH of SEQ ID NO: 6 and the VL of SEQ ID NO: 1.

In some embodiments, the scFv comprises the VH of SEQ ID NO: 6 and the VL of SEQ ID NO: 2.

In some embodiments, the scFv comprises the VH of SEQ ID NO: 6 and the VL of SEQ ID NO: 3.

In some embodiments, the scFv comprises the VH of SEQ ID NO: 6 and the VL of SEQ ID NO: 140.

In some embodiments, the scFv comprises the VH of SEQ ID NO: 6 and the VL of SEQ ID NO: 160.

In some embodiments, the scFv comprises the VH of SEQ ID NO: 139 and the VL of SEQ ID NO: 1.

In some embodiments, the scFv comprises the VH of SEQ ID NO: 139 and the VL of SEQ ID NO: 2.

In some embodiments, the scFv comprises the VH of SEQ ID NO: 139 and the VL of SEQ ID NO: 3.

In some embodiments, the scFv comprises the VH of SEQ ID NO: 139 and the VL of SEQ ID NO: 140.

In some embodiments, the scFv comprises the VH of SEQ ID NO: 139 and the VL of SEQ ID NO: 160.

In some embodiments, the scFv comprises the VH of SEQ ID NO: 159 and the VL of SEQ ID NO: 1.

In some embodiments, the scFv comprises the VH of SEQ ID NO: 159 and the VL of SEQ ID NO: 2.

In some embodiments, the scFv comprises the VH of SEQ ID NO: 159 and the VL of SEQ ID NO: 3.

In some embodiments, the scFv comprises the VH of SEQ ID NO: 159 and the VL of SEQ ID NO: 140.

In some embodiments, the scFv comprises the VH of SEQ ID NO: 159 and the VL of SEQ ID NO: 160.

In some embodiments, the scFv comprises the VH of SEQ ID NO: 161 and the VL of SEQ ID NO: 1.

In some embodiments, the scFv comprises the VH of SEQ ID NO: 161 and the VL of SEQ ID NO: 2.

In some embodiments, the scFv comprises the VH of SEQ ID NO: 161 and the VL of SEQ ID NO: 3.

In some embodiments, the scFv comprises the VH of SEQ ID NO: 161 and the VL of SEQ ID NO: 140.

In some embodiments, the scFv comprises the VH of SEQ ID NO: 161 and the VL of SEQ ID NO: 160.

In some embodiments, the scFv comprises the amino acid sequence of SEQ ID NO: 8.

In some embodiments, the scFv comprises the amino acid sequence of SEQ ID NO: 9.

In some embodiments, the scFv comprises the amino acid sequence of SEQ ID NO: 10.

In some embodiments, the scFv comprises the amino acid sequence of SEQ ID NO: 11.

In some embodiments, the scFv comprises the amino acid sequence of SEQ ID NO: 12.

In some embodiments, the scFv comprises the amino acid sequence of SEQ ID NO: 13.

In some embodiments, the scFv comprises the amino acid sequence of SEQ ID NO: 14.

In some embodiments, the scFv comprises the amino acid sequence of SEQ ID NO: 15.

In some embodiments, the scFv comprises the amino acid sequence of SEQ ID NO: 16.

In some embodiments, the scFv comprises the amino acid sequence of SEQ ID NO: 17.

In some embodiments, the scFv comprises the amino acid sequence of SEQ ID NO: 18.

In some embodiments, the scFv comprises the amino acid sequence of SEQ ID NO: 19.

In some embodiments, the scFv comprises the amino acid sequence of SEQ ID NO: 20.

In some embodiments, the scFv comprises the amino acid sequence of SEQ ID NO: 21.

In some embodiments, the scFv comprises the amino acid sequence of SEQ ID NO: 22.

In some embodiments, the scFv comprises the amino acid sequence of SEQ ID NO: 23.

In some embodiments, the scFv comprises the amino acid sequence of SEQ ID NO: 135.

In some embodiments, the scFv comprises the amino acid sequence of SEQ ID NO: 136.

In some embodiments, the scFv comprises the amino acid sequence of SEQ ID NO: 318.

In some embodiments, the scFv comprises the amino acid sequence of SEQ ID NO: 319.

In some embodiments, the scFv comprises the amino acid sequence of SEQ ID NO: 320.

In some embodiments, the scFv comprises the amino acid sequence of SEQ ID NO: 321.

In some embodiments, the scFv comprises the amino acid sequence of SEQ ID NO: 322.

In some embodiments, the scFv comprises the amino acid sequence of SEQ ID NO: 323.

Other Antigen Binding Domains that Bind hK2

Any of the VH and the VL domains identified herein that bind hK2 may also be engineered into Fab, F(ab')$_2$, Fd or Fv format and their binding to hK2 and thermostability may be assessed using the assays described herein.

In some embodiments, the Fab comprises
a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or
the HCDR1, the HCDR2 and the HCDR3 of the VH of SEQ ID NO: 162 and the LCDR1, the LCDR2 and the LCDR3 of the VL of SEQ ID NO: 163;
the HCDR1, the HCDR2 and the HCDR3 of the VH of SEQ ID NO: 164 and the LCDR, the LCDR2 and the LCDR3 of the VL of SEQ ID NO: 165;
the HCDR1, the HCDR2 and the HCDR3 of the VH of SEQ ID NO: 166 and the LCDR1, the LCDR2 and the LCDR3 of the VL of SEQ ID NO: 167;
the HCDR1, the HCDR2 and the HCDR3 of the VH of SEQ ID NO: 168 and the LCDR1, the LCDR2 and the LCDR3 of the VL of SEQ ID NO: 169; or
the HCDR1, the HCDR2 and the HCDR3 of the VH of SEQ ID NO: 204 and the LCDR1, the LCDR2 and the LCDR3 of the VL of SEQ ID NO: 205.

In a particular embodiment, the Fab comprises the HCDR1, the HCDR2 and the HCDR3 of the VH of SEQ ID NO: 162 and the LCDR1, the LCDR2 and the LCDR3 of the VL of SEQ ID NO: 163.

In some embodiments, the Fab comprises the HCDR1, HCDR1, the HCDR3, the LCDR1, the LCDR2 and the LCDR3 of
SEQ ID NOs: 63, 65, 66, 67, 69, 71, respectively;
SEQ ID NOs: 63, 65, 66, 68, 70, 71, respectively;
SEQ ID NOs: 72, 73, 66, 67, 69, 71, respectively;
SEQ ID NOs: 141, 142, 143, 144, 145 and 146, respectively;
SEQ ID NOs: 170, 171, 172, 173, 174 and 175, respectively;
SEQ ID NOs: 176, 177, 178, 179, 180 and 181, respectively;
SEQ ID NOs: 170, 183, 184, 185, 186, and 187, respectively;
SEQ ID NOs: 188, 189, 190, 191, 192, and 193, respectively;
SEQ ID NOs: 206, 207, 208, 182, 470, 209, respectively;
SEQ ID NOs: 147, 148, 143, 144, 145 and 146, respectively;
SEQ ID NOs: 194, 195, 172, 173, 174, and 175, respectively;
SEQ ID NOs: 196, 197, 178, 179, 180, 181, respectively;
SEQ ID NOs: 198, 199, 184, 185, 186, and 187, respectively;
SEQ ID NOs: 200, 201, 190, 191, 192, and 193, respectively; or
SEQ ID NOs: 216, 217, 218, 182, 470, and 209, respectively.

In some embodiments, the Fab comprises the HCDR1, the HCDR1, the HCDR3, the LCDR1, the LCDR2 and the LCDR3 of SEQ ID NOs: 141, 142, 143, 144, 145 and 146, respectively.

In some embodiments, the Fab comprises the HCDR1, the HCDR1, the HCDR3, the LCDR1, the LCDR2 and the LCDR3 of SEQ ID NOs: 170, 171, 172, 173, 174 and 175, respectively.

In some embodiments, the Fab comprises the HCDR1, the HCDR1, the HCDR3, the LCDR1, the LCDR2 and the LCDR3 of SEQ ID NOs: 176, 177, 178, 179, 180 and 181, respectively.

In some embodiments, the Fab comprises the HCDR1, the HCDR1, the HCDR3, the LCDR1, the LCDR2 and the LCDR3 of SEQ ID NOs: 170, 183, 184, 185, 186, and 187, respectively.

In some embodiments, the Fab comprises the HCDR1, the HCDR1, the HCDR3, the LCDR1, the LCDR2 and the LCDR3 of SEQ ID NOs: 188, 189, 190, 191, 192, and 193, respectively.

In some embodiments, the Fab comprises the HCDR1, the HCDR1, the HCDR3, the LCDR1, the LCDR2 and the LCDR3 of SEQ ID NOs: 206, 207, 208, 182, 470, 209, respectively.

In some embodiments, the Fab comprises the HCDR1, the HCDR1, the HCDR3, the LCDR1, the LCDR2 and the LCDR3 of SEQ ID NOs: 147, 148, 143, 144, 145 and 146, respectively.

In some embodiments, the Fab comprises the HCDR1, the HCDR1, the HCDR3, the LCDR1, the LCDR2 and the LCDR3 of SEQ ID NOs: 194, 195, 172, 173, 174, and 175, respectively.

In some embodiments, the Fab comprises the HCDR1, the HCDR1, the HCDR3, the LCDR1, the LCDR2 and the LCDR3 of SEQ ID NOs: 196, 197, 178, 179, 180, 181, respectively.

In some embodiments, the Fab comprises the HCDR1, the HCDR1, the HCDR3, the LCDR1, the LCDR2 and the LCDR3 of SEQ ID NOs: 198, 199, 184, 185, 186, and 187, respectively.

In some embodiments, the Fab comprises the HCDR1, the HCDR1, the HCDR3, the LCDR1, the LCDR2 and the LCDR3 of SEQ ID NOs: 200, 201, 190, 191, 192, and 193, respectively.

In some embodiments, the Fab comprises the HCDR1, the HCDR1, the HCDR3, the LCDR1, the LCDR2 and the LCDR3 of SEQ ID NOs: 216, 217, 218, 182, 470, and 209, respectively.

In a particular embodiment, the Fab comprises the HCDR1, the HCDR1, the HCDR3, the LCDR1, the LCDR2 and the LCDR3 of SEQ ID NOs: 170, 171, 172, 173, 174 and 175, respectively or of SEQ ID NOs: 194, 195, 172, 173, 174, and 175, respectively.

In some embodiments, the Fab comprises the VH of SEQ ID NO: 137 and the VL of SEQ ID NO: 138.

In some embodiments, the Fab comprises the VH of SEQ ID NO: 162 and the VL of SEQ ID NO: 163.

In some embodiments, the Fab comprises the VH of SEQ ID NO: 164 and the VL of SEQ ID NO: 165.

In some embodiments, the Fab comprises the VH of SEQ ID NO: 166 and the VL of SEQ ID NO: 167.

In some embodiments, the Fab comprises the VH of SEQ ID NO: 168 and the VL of SEQ ID NO: 169.

In some embodiments, the Fab comprises the VH of SEQ ID NO: 204 and the VL of SEQ ID NO: 205.

In some embodiments, the Fab comprises the VH of SEQ ID NO: 75 and the VL of SEQ ID NO: 74.

In a particular embodiment, the Fab comprises a VH of SEQ ID NO: 162 and a VL of SEQ ID NO: 163.

In some embodiments, the Fab comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163.

In some embodiments, the Fab comprises a VH which is at least 80% (e.g. at least 85%, at least 90%, at least 95% or at least 99%) identical to the VH of SEQ ID NO: 162 and a VL of SEQ ID NO: 163.

In some embodiments, the Fab comprises a VH of SEQ ID NO: 162 and a VL which is at least 80% (e.g. at least 85%, at least 90%, at least 95% or at least 99%) identical to the VL of SEQ ID NO: 163.

In some embodiments, the Fab comprises a VH which is at least 95% identical to the VH of SEQ ID NO: 162 and a VL which is at least 95% identical to the VL of SEQ ID NO: 163.

In some embodiments, the Fab comprises a VH which is at least 99% identical to the VH of SEQ ID NO: 162 and a VL which is at least 95% identical to the VL of SEQ ID NO: 163.

In some embodiments, the Fab comprises a VH which is at least 99% identical to the VH of SEQ ID NO: 162 and a VL which is at least 99% identical to the VL of SEQ ID NO: 163.

In some embodiments, the Fab comprises a VH which is at least 99% identical to the VH of SEQ ID NO: 162 and a VL which is at least 95% identical to the VL of SEQ ID NO: 163.

In some embodiments, the Fab comprises a VH which is at least 80% (e.g. at least 85%, at least 90%, at least 95% or at least 99%) identical to the VH of SEQ ID NO: 137 and a VL which is at least 80% (e.g. at least 85%, at least 90%, at least 95% or at least 99%) identical to the VL of SEQ ID NO: 138.

In some embodiments, the Fab comprises a VH which is at least 80% (e.g. at least 85%, at least 90%, at least 95% or at least 99%) identical to the VH of SEQ ID NO: 164 and a VL which is at least 80% (e.g. at least 85%, at least 90%, at least 95% or at least 99%) identical to the VL of SEQ ID NO: 165.

In some embodiments, the Fab comprises a VH which is at least 80% (e.g. at least 85%, at least 90%, at least 95% or at least 99%) identical to the VH of SEQ ID NO: 166 and a VL which is at least 80% (e.g. at least 85%, at least 90%, at least 95% or at least 99%) identical to the VL of SEQ ID NO: 167.

In some embodiments, the Fab comprises a VH which is at least 80% (e.g. at least 85%, at least 90%, at least 95% or at least 99%) identical to the VH of SEQ ID NO: 168 and a VL which is at least 80% (e.g. at least 85%, at least 90%, at least 95% or at least 99%) identical to the VL of SEQ ID NO: 169.

In some embodiments, the Fab comprises a VH which is at least 80% (e.g. at least 85%, at least 90%, at least 95% or at least 99%) identical to the VH of SEQ ID NO: 204 and a VL which is at least 80% (e.g. at least 85%, at least 90%, at least 95% or at least 99%) identical to the VL of SEQ ID NO: 205.

In some embodiments, the Fab comprises the VH of SEQ ID NOs: 4, 5, 6, 139, 159 or 161 and the VL of SEQ ID NOs: 1, 2, 3, 140 or 160, with the proviso that the Fab does not comprise the VH of SEQ ID NO: 5 and the VL of SEQ ID NO: 2.

In some embodiments, the Fab comprises the VH of SEQ ID NO: 4 and the VL of SEQ ID NO: 1.

In some embodiments, the Fab comprises the VH of SEQ ID NO: 4 and the VL of SEQ ID NO: 2.

In some embodiments, the Fab comprises the VH of SEQ ID NO: 4 and the VL of SEQ ID NO: 3.

In some embodiments, the Fab comprises the VH of SEQ ID NO: 4 and the VL of SEQ ID NO: 140.

In some embodiments, the Fab comprises the VH of SEQ ID NO: 4 and the VL of SEQ ID NO: 160.

In some embodiments, the Fab comprises the VH of SEQ ID NO: 5 and the VL of SEQ ID NO: 1.

In some embodiments, the Fab comprises the VH of SEQ ID NO: 5 and the VL of SEQ ID NO: 3.

In some embodiments, the Fab comprises the VH of SEQ ID NO: 5 and the VL of SEQ ID NO: 140.

In some embodiments, the Fab comprises the VH of SEQ ID NO: 5 and the VL of SEQ ID NO: 160.

In some embodiments, the Fab comprises the VH of SEQ ID NO: 6 and the VL of SEQ ID NO: 1.

In some embodiments, the Fab comprises the VH of SEQ ID NO: 6 and the VL of SEQ ID NO: 2.

In some embodiments, the Fab comprises the VH of SEQ ID NO: 6 and the VL of SEQ ID NO: 3.

In some embodiments, the Fab comprises the VH of SEQ ID NO: 6 and the VL of SEQ ID NO: 140.

In some embodiments, the Fab comprises the VH of SEQ ID NO: 6 and the VL of SEQ ID NO: 160.

In some embodiments, the Fab comprises the VH of SEQ ID NO: 139 and the VL of SEQ ID NO: 1.

In some embodiments, the Fab comprises the VH of SEQ ID NO: 139 and the VL of SEQ ID NO: 2.

In some embodiments, the Fab comprises the VH of SEQ ID NO: 139 and the VL of SEQ ID NO: 3.

In some embodiments, the Fab comprises the VH of SEQ ID NO: 139 and the VL of SEQ ID NO: 140.

In some embodiments, the Fab comprises the VH of SEQ ID NO: 139 and the VL of SEQ ID NO: 160.

In some embodiments, the Fab comprises the VH of SEQ ID NO: 159 and the VL of SEQ ID NO: 1.

In some embodiments, the Fab comprises the VH of SEQ ID NO: 159 and the VL of SEQ ID NO: 2.

In some embodiments, the Fab comprises the VH of SEQ ID NO: 159 and the VL of SEQ ID NO: 3.

In some embodiments, the Fab comprises the VH of SEQ ID NO: 159 and the VL of SEQ ID NO: 140.

In some embodiments, the Fab comprises the VH of SEQ ID NO: 159 and the VL of SEQ ID NO: 160.

In some embodiments, the Fab comprises the VH of SEQ ID NO: 161 and the VL of SEQ ID NO: 1.

In some embodiments, the Fab comprises the VH of SEQ ID NO: 161 and the VL of SEQ ID NO: 2.

In some embodiments, the Fab comprises the VH of SEQ ID NO: 161 and the VL of SEQ ID NO: 3.

In some embodiments, the Fab comprises the VH of SEQ ID NO: 161 and the VL of SEQ ID NO: 140.

In some embodiments, the Fab comprises the VH of SEQ ID NO: 161 and the VL of SEQ ID NO: 160.

The VH and VL of the Fab comprising the antigen binding domain that binds hK2 may be engineered into Fab-Fc HC (VH-CH1-hinge-CH2-CH3) and Fab-Fc LC (VL-CL) formats respectively. In certain such embodiments, the Fab-Fc HC comprises an amino acid sequence which is at least 80% (e.g. at least 85%, at least 90%, at least 95% or at least 99%) identical to SEQ ID NO: 354. In a particular embodiment, the Fab-Fc HC comprises an amino acid sequence which is identical to SEQ ID NO: 354

In some embodiments, the Fab-Fc HC comprises a C-terminal lysine residue (e.g. K477). In some embodiments, the Fab-Fc HC comprises an amino acid sequence having a C-terminal lysine residue and a sequence which is at least 80% (e.g. at least 85%, at least 90%, at least 95% or at least 99%) identical to SEQ ID NO: 361. In a particular embodiment, the Fab-Fc HC comprises an amino acid sequence of SEQ ID NO:361.

In some embodiments, the Fab-Fc LC comprises an amino acid sequence which is at least 80% (e.g. at least 85%, at least 90%, at least 95% or at least 99%) identical to SEQ ID NO: 221. In a particular embodiment, the Fab-Fc LC comprises an amino acid sequence which is identical to SEQ ID NO: 221

As shown in the examples, a particularly suitable antigen binding domain that binds hK2 for incorporating into a multispecific construct comprises a Fab-Fc HC having the amino acid sequence of SEQ ID NO: 354 and a Fab-Fc LC having the amino acid sequence of SEQ ID NO: 221.

In some embodiments, the F(ab')$_2$ comprises
a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or
the HCDR1, the HCDR2 and the HCDR3 of the VH of SEQ ID NO: 162 and the LCDR1, the LCDR2 and the LCDR3 of the VL of SEQ ID NO: 163;
the HCDR1, the HCDR2 and the HCDR3 of the VH of SEQ ID NO: 164 and the LCDR1, the LCDR2 and the LCDR3 of the VL of SEQ ID NO: 165;
the HCDR1, the HCDR2 and the HCDR3 of the VH of SEQ ID NO: 166 and the LCDR1, the LCDR2 and the LCDR3 of the VL of SEQ ID NO: 167:
the HCDR1, the HCDR2 and the HCDR3 of the VH of SEQ ID NO: 168 and the LCDR1, the LCDR2 and the LCDR3 of the VL of SEQ ID NO: 169; or
the HCDR1, the HCDR2 and the HCDR3 of the VH of SEQ ID NO: 204 and the LCDR1, the LCDR2 and the LCDR3 of the VL of SEQ ID NO: 205.

In some embodiments, the F(ab')$_2$ comprises the HCDR1, the HCDR1, the HCDR3, the LCDR1, the LCDR2 and the LCDR3 of
SEQ ID NOs: 141, 142, 143, 144, 145 and 146, respectively;
SEQ ID NOs: 170, 171, 172, 173, 174 and 175, respectively;
SEQ ID NOs: 176, 177, 178, 179, 180 and 181, respectively;
SEQ ID NOs: 170, 183, 184, 185, 186, and 187, respectively;
SEQ ID NOs: 188, 189, 190, 191, 192, and 193, respectively;
SEQ ID NOs: 206, 207, 208, 182, 470, 209, respectively;
SEQ ID NOs: 147, 148, 143, 144, 145 and 146, respectively;
SEQ ID NOs: 194, 195, 172, 173, 174, and 175, respectively;
SEQ ID NOs: 196, 197, 178, 179, 180, 181, respectively;
SEQ ID NOs: 198, 199, 184, 185, 186, and 187, respectively;
SEQ ID NOs: 200, 201, 190, 191, 192, and 193, respectively; or
SEQ ID NOs: 216, 217, 218, 182, 470, and 209, respectively.

In some embodiments, the F(ab')$_2$ comprises the HCDR1, the HCDR1, the HCDR3, the LCDR1, the LCDR2 and the LCDR3 of SEQ ID NOs: 141, 142, 143, 144, 145 and 146, respectively.

In some embodiments, the F(ab')$_2$ comprises the HCDR1, the HCDR1, the HCDR3, the LCDR1, the LCDR2 and the LCDR3 of SEQ ID NOs: 170, 171, 172, 173, 174 and 175, respectively.

In some embodiments, the F(ab')$_2$ comprises the HCDR1, the HCDR1, the HCDR3, the LCDR1, the LCDR2 and the LCDR3 of SEQ ID NOs: 176, 177, 178, 179, 180 and 181, respectively.

In some embodiments, the F(ab')$_2$ comprises the HCDR1, the HCDR1, the HCDR3, the LCDR1, the LCDR2 and the LCDR3 of SEQ ID NOs: 170, 183, 184, 185, 186, and 187, respectively.

In some embodiments, the F(ab')$_2$ comprises the HCDR1, the HCDR1, the HCDR3, the LCDR1, the LCDR2 and the LCDR3 of SEQ ID NOs: 188, 189, 190, 191, 192, and 193, respectively.

In some embodiments, the F(ab')$_2$ comprises the HCDR1, the HCDR1, the HCDR3, the LCDR1, the LCDR2 and the LCDR3 of SEQ ID NOs: 206, 207, 208, 182, 470, 209, respectively.

In some embodiments, the F(ab')$_2$ comprises the HCDR1, the HCDR1, the HCDR3, the LCDR1, the LCDR2 and the LCDR3 of SEQ ID NOs: 147, 148, 143, 144, 145 and 146, respectively.

In some embodiments, the F(ab')$_2$ comprises the HCDR1, the HCDR1, the HCDR3, the LCDR1, the LCDR2 and the LCDR3 of SEQ ID NOs: 194, 195, 172, 173, 174, and 175, respectively.

In some embodiments, the F(ab')$_2$ comprises the HCDR1, the HCDR1, the HCDR3, the LCDR1, the LCDR2 and the LCDR3 of SEQ ID NOs: 196, 197, 178, 179, 180, 181, respectively.

In some embodiments, the F(ab')$_2$ comprises the HCDR1, the HCDR1, the HCDR3, the LCDR1, the LCDR2 and the LCDR3 of SEQ ID NOs: 198, 199, 184, 185, 186, and 187, respectively.

In some embodiments, the F(ab')$_2$ comprises the HCDR1, the HCDR1, the HCDR3, the LCDR1, the LCDR2 and the LCDR3 of SEQ ID NOs: 200, 201, 190, 191, 192, and 193, respectively.

In some embodiments, the F(ab')$_2$ comprises the HCDR1, the HCDR1, the HCDR3, the LCDR1, the LCDR2 and the LCDR3 of SEQ ID NOs: 216, 217, 218, 182, 470, and 209, respectively.

In some embodiments, the F(ab')$_2$ comprises the VH of SEQ ID NO: 137 and the VL of SEQ ID NO: 138.

In some embodiments, the F(ab')$_2$ comprises the VH of SEQ ID NO: 162 and the VL of SEQ ID NO: 163.

In some embodiments, the F(ab')$_2$ comprises the VH of SEQ ID NO: 164 and the VL of SEQ ID NO: 165.

In some embodiments, the F(ab')$_2$ comprises the VH of SEQ ID NO: 166 and the VL of SEQ ID NO: 167.

In some embodiments, the F(ab')$_2$ comprises the VH of SEQ ID NO: 168 and the VL of SEQ ID NO: 169.

In some embodiments, the F(ab')$_2$ comprises the VH of SEQ ID NO: 204 and the VL of SEQ ID NO: 205.

In some embodiments, the F(ab')$_2$ comprises the VH of SEQ ID NO: 75 and the VL of SEQ ID NO: 74.

In some embodiments, the F(ab')$_2$ comprises the VH of SEQ ID NOs: 4, 5, 6, 139, 159 or 161 and the VL of SEQ ID NOs: 1, 2, 3, 140 or 160, with the proviso that the Fab does not comprise the VH of SEQ ID NO: 5 and the VL of SEQ ID NO: 2.

In some embodiments, the F(ab')$_2$ comprises the VH of SEQ ID NO: 4 and the VL of SEQ ID NO: 1.

In some embodiments, the F(ab')$_2$ comprises the VH of SEQ ID NO: 4 and the VL of SEQ ID NO: 2.

In some embodiments, the F(ab')$_2$ comprises the VH of SEQ ID NO: 4 and the VL of SEQ ID NO: 3.

In some embodiments, the F(ab')$_2$ comprises the VH of SEQ ID NO: 4 and the VL of SEQ ID NO: 140.

In some embodiments, the F(ab')$_2$ comprises the VH of SEQ ID NO: 4 and the VL of SEQ ID NO: 160.

In some embodiments, the F(ab')$_2$ comprises the VH of SEQ ID NO: 5 and the VL of SEQ ID NO: 1.

In some embodiments, the F(ab')$_2$ comprises the VH of SEQ ID NO: 5 and the VL of SEQ ID NO: 3.

In some embodiments, the F(ab')$_2$ comprises the VH of SEQ ID NO: 5 and the VL of SEQ ID NO: 140.

In some embodiments, the F(ab')$_2$ comprises the VH of SEQ ID NO: 5 and the VL of SEQ ID NO: 160.

In some embodiments, the F(ab')$_2$ comprises the VH of SEQ ID NO: 6 and the VL of SEQ ID NO: 1.

In some embodiments, the F(ab')$_2$ comprises the VH of SEQ ID NO: 6 and the VL of SEQ ID NO: 2.

In some embodiments, the F(ab')$_2$ comprises the VH of SEQ ID NO: 6 and the VL of SEQ ID NO: 3.

In some embodiments, the F(ab')$_2$ comprises the VH of SEQ ID NO: 6 and the VL of SEQ ID NO: 140.

In some embodiments, the F(ab')$_2$ comprises the VH of SEQ ID NO: 6 and the VL of SEQ ID NO: 160.

In some embodiments, the F(ab')$_2$ comprises the VH of SEQ ID NO: 139 and the VL of SEQ ID NO: 1.

In some embodiments, the F(ab')$_2$ comprises the VH of SEQ ID NO: 139 and the VL of SEQ ID NO: 2.

In some embodiments, the F(ab')$_2$ comprises the VH of SEQ ID NO: 139 and the VL of SEQ ID NO: 3.

In some embodiments, the F(ab')$_2$ comprises the VH of SEQ ID NO: 139 and the VL of SEQ ID NO: 140.

In some embodiments, the F(ab')$_2$ comprises the VH of SEQ ID NO: 139 and the VL of SEQ ID NO: 160.

In some embodiments, the F(ab')$_2$ comprises the VH of SEQ ID NO: 159 and the VL of SEQ ID NO: 1.

In some embodiments, the F(ab')$_2$ comprises the VH of SEQ ID NO: 159 and the VL of SEQ ID NO: 2.

In some embodiments, the F(ab')$_2$ comprises the VH of SEQ ID NO: 159 and the VL of SEQ ID NO: 3.

In some embodiments, the F(ab')$_2$ comprises the VH of SEQ ID NO: 159 and the VL of SEQ ID NO: 140.

In some embodiments, the F(ab')$_2$ comprises the VH of SEQ ID NO: 159 and the VL of SEQ ID NO: 160.

In some embodiments, the F(ab')$_2$ comprises the VH of SEQ ID NO: 161 and the VL of SEQ ID NO: 1.

In some embodiments, the F(ab')$_2$ comprises the VH of SEQ ID NO: 161 and the VL of SEQ ID NO: 2.

In some embodiments, the F(ab')$_2$ comprises the VH of SEQ ID NO: 161 and the VL of SEQ ID NO: 3.

In some embodiments, the F(ab')$_2$ comprises the VH of SEQ ID NO: 161 and the VL of SEQ ID NO: 140.

In some embodiments, the F(ab')$_2$ comprises the VH of SEQ ID NO: 161 and the VL of SEQ ID NO: 160.

In some embodiments, the Fv comprises
a heavy chain complementarity determining region (HCDR) 1, a HCDR2 and a HCDR3 of a heavy chain variable region (VH) of SEQ ID NO: 137 and a light chain complementarity determining region (LCDR) 1, a LCDR2 and a LCDR3 of a light chain variable region (VL) of SEQ ID NO: 138; or the HCDR1, the HCDR2 and the HCDR3 of the VH of SEQ ID NO: 162 and the LCDR, the LCDR2 and the LCDR3 of the VL of SEQ ID NO: 163;

the HCDR1, the HCDR2 and the HCDR3 of the VH of SEQ ID NO: 164 and the LCDR, the LCDR2 and the LCDR3 of the VL of SEQ ID NO: 165;

the HCDR1, the HCDR2 and the HCDR3 of the VH of SEQ ID NO: 166 and the LCDR1, the LCDR2 and the LCDR3 of the VL of SEQ ID NO: 167;

the HCDR1, the HCDR2 and the HCDR3 of the VH of SEQ ID NO: 168 and the LCDR1, the LCDR2 and the LCDR3 of the VL of SEQ ID NO: 169; or the HCDR1, the HCDR2 and the HCDR3 of the VH of SEQ ID NO: 204 and the LCDR1, the LCDR2 and the LCDR3 of the VL of SEQ ID NO: 205.

In some embodiments, the Fv comprises the HCDR1, the HCDR1, the HCDR3, the LCDR1, the LCDR2 and the LCDR3 of SEQ ID NOs: 141, 142, 143, 144, 145 and 146, respectively;
SEQ ID NOs: 170, 171, 172, 173, 174 and 175, respectively;
SEQ ID NOs: 176, 177, 178, 179, 180 and 181, respectively;
SEQ ID NOs: 170, 183, 184, 185, 186, and 187, respectively;
SEQ ID NOs: 188, 189, 190, 191, 192, and 193, respectively;
SEQ ID NOs: 206, 207, 208, 182, 470, 209, respectively;
SEQ ID NOs: 147, 148, 143, 144, 145 and 146, respectively;
SEQ ID NOs: 194, 195, 172, 173, 174, and 175, respectively;
SEQ ID NOs: 196, 197, 178, 179, 180, 181, respectively;
SEQ ID NOs: 198, 199, 184, 185, 186, and 187, respectively;
SEQ ID NOs: 200, 201, 190, 191, 192, and 193, respectively; or
SEQ ID NOs: 216, 217, 218, 182, 470, and 209, respectively.

In some embodiments, the Fv comprises the HCDR1, the HCDR1, the HCDR3, the LCDR1, the LCDR2 and the LCDR3 of SEQ ID NOs: 141, 142, 143, 144, 145 and 146, respectively.

In some embodiments, the Fv comprises the HCDR1, the HCDR1, the HCDR3, the LCDR1, the LCDR2 and the LCDR3 of SEQ ID NOs: 170, 171, 172, 173, 174 and 175, respectively.

In some embodiments, the Fv comprises the HCDR1, the HCDR1, the HCDR3, the LCDR1, the LCDR2 and the LCDR3 of SEQ ID NOs: 176, 177, 178, 179, 180 and 181, respectively.

In some embodiments, the Fv comprises the HCDR1, the HCDR1, the HCDR3, the LCDR1, the LCDR2 and the LCDR3 of SEQ ID NOs: 170, 183, 184, 185, 186, and 187, respectively.

In some embodiments, the Fv comprises the HCDR1, the HCDR1, the HCDR3, the LCDR1, the LCDR2 and the LCDR3 of SEQ ID NOs: 188, 189, 190, 191, 192, and 193, respectively.

In some embodiments, the Fv comprises the HCDR1, the HCDR1, the HCDR3, the LCDR1, the LCDR2 and the LCDR3 of SEQ ID NOs: 206, 207, 208, 182, 470, 209, respectively.

In some embodiments, the Fv comprises the HCDR1, the HCDR1, the HCDR3, the LCDR1, the LCDR2 and the LCDR3 of SEQ ID NOs: 147, 148, 143, 144, 145 and 146, respectively.

In some embodiments, the Fv comprises the HCDR1, the HCDR1, the HCDR3, the LCDR1, the LCDR2 and the LCDR3 of SEQ ID NOs: 194, 195, 172, 173, 174, and 175, respectively.

In some embodiments, the Fv comprises the HCDR1, the HCDR1, the HCDR3, the LCDR1, the LCDR2 and the LCDR3 of SEQ ID NOs: 196, 197, 178, 179, 180, 181, respectively.

In some embodiments, the Fv comprises the HCDR1, the HCDR1, the HCDR3, the LCDR1, the LCDR2 and the LCDR3 of SEQ ID NOs: 198, 199, 184, 185, 186, and 187, respectively.

In some embodiments, the Fv comprises the HCDR1, the HCDR1, the HCDR3, the LCDR1, the LCDR2 and the LCDR3 of SEQ ID NOs: 200, 201, 190, 191, 192, and 193, respectively.

In some embodiments, the Fv comprises the HCDR1, the HCDR1, the HCDR3, the LCDR1, the LCDR2 and the LCDR3 of SEQ ID NOs: 216, 217, 218, 182, 470, and 209, respectively.

In some embodiments, the Fv comprises the VH of SEQ ID NO: 137 and the VL of SEQ ID NO: 138.

In some embodiments, the Fv comprises the VH of SEQ ID NO: 162 and the VL of SEQ ID NO: 163.

In some embodiments, the Fv comprises the VH of SEQ ID NO: 164 and the VL of SEQ ID NO: 165.

In some embodiments, the Fv comprises the VH of SEQ ID NO: 166 and the VL of SEQ ID NO: 167.

In some embodiments, the Fv comprises the VH of SEQ ID NO: 168 and the VL of SEQ ID NO: 169.

In some embodiments, the Fv comprises the VH of SEQ ID NO: 204 and the VL of SEQ ID NO: 205.

In some embodiments, the Fv comprises the VH of SEQ ID NO: 75 and the VL of SEQ ID NO: 74.

In some embodiments, the Fv comprises the VH of SEQ ID NOs: 4, 5 or 6 and the VL of SEQ ID NOs: 1, 2 or 3.

In some embodiments, the Fv comprises the VH of SEQ ID NOs: 4, 5, 6, 139, 159 or 161 and the VL of SEQ ID NOs: 1, 2, 3, 140 or 160, with the proviso that the Fab does not comprise the VH of SEQ ID NO: 5 and the VL of SEQ ID NO: 2.

In some embodiments, the Fv comprises the VH of SEQ ID NO: 4 and the VL of SEQ ID NO: 1.

In some embodiments, the Fv comprises the VH of SEQ ID NO: 4 and the VL of SEQ ID NO: 2.

In some embodiments, the Fv comprises the VH of SEQ ID NO: 4 and the VL of SEQ ID NO: 3.

In some embodiments, the Fv comprises the VH of SEQ ID NO: 4 and the VL of SEQ ID NO: 140.

In some embodiments, the Fv comprises the VH of SEQ ID NO: 4 and the VL of SEQ ID NO: 160.

In some embodiments, the Fv comprises the VH of SEQ ID NO: 5 and the VL of SEQ ID NO: 1.

In some embodiments, the Fv comprises the VH of SEQ ID NO: 5 and the VL of SEQ ID NO: 3.

In some embodiments, the Fv comprises the VH of SEQ ID NO: 5 and the VL of SEQ ID NO: 140.

In some embodiments, the Fv comprises the VH of SEQ ID NO: 5 and the VL of SEQ ID NO: 160.

In some embodiments, the Fv comprises the VH of SEQ ID NO: 6 and the VL of SEQ ID NO: 1.

In some embodiments, the Fv comprises the VH of SEQ ID NO: 6 and the VL of SEQ ID NO: 2.

In some embodiments, the Fv comprises the VH of SEQ ID NO: 6 and the VL of SEQ ID NO: 3.

In some embodiments, the Fv comprises the VH of SEQ ID NO: 6 and the VL of SEQ ID NO: 140.

In some embodiments, the Fv comprises the VH of SEQ ID NO: 6 and the VL of SEQ ID NO: 160.

In some embodiments, the Fv comprises the VH of SEQ ID NO: 139 and the VL of SEQ ID NO: 1.

In some embodiments, the Fv comprises the VH of SEQ ID NO: 139 and the VL of SEQ ID NO: 2.

In some embodiments, the Fv comprises the VH of SEQ ID NO: 139 and the VL of SEQ ID NO: 3.

In some embodiments, the Fv comprises the VH of SEQ ID NO: 139 and the VL of SEQ ID NO: 140.

In some embodiments, the Fv comprises the VH of SEQ ID NO: 139 and the VL of SEQ ID NO: 160.

In some embodiments, the Fv comprises the VH of SEQ ID NO: 159 and the VL of SEQ ID NO: 1.

In some embodiments, the Fv comprises the VH of SEQ ID NO: 159 and the VL of SEQ ID NO: 2.

In some embodiments, the Fv comprises the VH of SEQ ID NO: 159 and the VL of SEQ ID NO: 3.

In some embodiments, the Fv comprises the VH of SEQ ID NO: 159 and the VL of SEQ ID NO: 140.

In some embodiments, the Fv comprises the VH of SEQ ID NO: 159 and the VL of SEQ ID NO: 160.

In some embodiments, the Fv comprises the VH of SEQ ID NO: 161 and the VL of SEQ ID NO: 1.

In some embodiments, the Fv comprises the VH of SEQ ID NO: 161 and the VL of SEQ ID NO: 2.

In some embodiments, the Fv comprises the VH of SEQ ID NO: 161 and the VL of SEQ ID NO: 3.

In some embodiments, the Fv comprises the VH of SEQ ID NO: 161 and the VL of SEQ ID NO: 140.

In some embodiments, the Fv comprises the VH of SEQ ID NO: 161 and the VL of SEQ ID NO: 160.

In some embodiments, the Fd comprises the VH of SEQ ID NO: 75.

In some embodiments, the Fd comprises the VH of SEQ ID NO: 4.

In some embodiments, the Fd comprises the VH of SEQ ID NO: 5.

In some embodiments, the Fd comprises the VH of SEQ ID NO: 6.

In some embodiments, the isolated anti-hK2 antibody or the antigen binding fragment thereof comprises a HC of SEQ ID NO: 210 and a LC of SEQ ID NO: 221.

In some embodiments, the isolated anti-hK2 antibody or the antigen binding fragment thereof comprises a HC of SEQ ID NO: 211 and a LC of SEQ ID NO: 222.

In some embodiments, the isolated anti-hK2 antibody or the antigen binding fragment thereof comprises a HC of SEQ ID NO: 212 and a LC of SEQ ID NO: 223.

In some embodiments, the isolated anti-hK2 antibody or the antigen binding fragment thereof comprises a HC of SEQ ID NO: 213 and a LC of SEQ ID NO: 224.

In some embodiments, the isolated anti-hK2 antibody or the antigen binding fragment thereof comprises a HC of SEQ ID NO: 219 and a LC of SEQ ID NO: 220.

In some embodiments, the isolated anti-hK2 antibody or the antigen binding fragment thereof comprises a HC which is at least 80% (e.g. at least 85%, at least 90%, at least 95% or at least 99%) identical to SEQ ID NO: 354 and a LC which is at least 80% (e.g. at least 85%, at least 90%, at least 95% or at least 99%) identical to SEQ ID NO: 221.

In some embodiments, the isolated anti-hK2 antibody or the antigen binding fragment thereof comprises a HC which is at least 80% (e.g. at least 85%, at least 90%, at least 95% or at least 99%) identical to SEQ ID NO: 354 and a LC of SEQ ID NO: 221.

In some embodiments, the isolated anti-hK2 antibody or the antigen binding fragment thereof comprises a HC of SEQ ID NO: 354 and a LC which is at least 80% (e.g. at least 85%, at least 90%, at least 95% or at least 99%) identical to SEQ ID NO: 221.

In some embodiments, the isolated anti-hK2 antibody or the antigen binding fragment thereof comprises a HC which is at least 95% identical to SEQ ID NO: 354 and a LC which is at least 95% identical to SEQ ID NO: 221.

In some embodiments, the isolated anti-hK2 antibody or the antigen binding fragment thereof comprises a HC which is at least 99% identical to SEQ ID NO: 354 and a LC which is at least 95% identical to SEQ ID NO: 221.

In some embodiments, the isolated anti-hK2 antibody or the antigen binding fragment thereof comprises a HC which is at least 99% identical to SEQ ID NO: 354 and a LC which is at least 99% identical to SEQ ID NO: 221.

In some embodiments, the isolated anti-hK2 antibody or the antigen binding fragment thereof comprises a HC which is at least 95% identical to SEQ ID NO: 354 and a LC which is at least 99% identical to SEQ ID NO: 221.

In a particular embodiment, the isolated anti-hK2 antibody or the antigen binding fragment thereof comprises a HC of SEQ ID NO: 354 and a LC of SEQ ID NO: 221

Homologous Antigen Binding Domains and Antigen Binding Domains with Conservative Substitutions Variants of the antigen binding domains that bind hK2 are within the scope of the disclosure. For example, variants may comprise 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acid substitutions in the antigen binding domain that bind hK2 as long as they retain or have improved functional properties when compared to the parent antigen binding domains. In some embodiments, the sequence identity may be about 80%, 81%, 82%, 83%, 84%, 85%, 86%, 87%, 88%, 89%, 90%, 91%, 92%, 93%, 94%, 95%, 96%, 97%, 98% or 99% to the antigen binding domains that bind hK2 of the disclosure. In some embodiments, the variation is in the framework regions. In some embodiments, variants are generated by conservative substitutions.

For example, the antigen binding domains that bind hK2 may comprise substitutions at residue positions D16, A23, P41, G45, I49, M70, and A88, and V89 in the VH (residue numbering according to the hu11B6_VH of SEQ ID NO: 5) and D1, D9, S10, A12, V13, L15, I21, N22, K24, K49, R58, V62, D64, S80, L82, Q83, A84, V87, A88, Y91, Q104, and L108 in the VL (residue numbering according to the hu11B6_VL of SEQ ID NO: 2). Conservative substitutions may be made at any indicated positions and the resulting variant antigen binding domains that bind hK2 are tested for their desired characteristics in the assays described herein.

In some embodiments, an isolated protein comprising an antigen binding domain that binds hK2 comprises a VH and a VL which are at least 80% (e.g. at least 85%, at least 90%, at least 95% or at least 99%) identical to the VH and VL, respectively, of an antigen binding domain that binds hK2 disclosed herein.

Also provided are antigen binding domains that bind hK2 comprising the VH and the VL which are at least 80% identical to
the VH of SEQ ID NO: 137 and the VL of SEQ ID NO: 138;
the VH of SEQ ID NO: 139 and the VL of SEQ ID NO: 140;
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 5 and the VL of SEQ ID NO: 1;
the VH of SEQ ID NO: 5 and the VL of SEQ ID NO: 3;
the VH of SEQ ID NO: 6 and the VL of SEQ ID NO: 1;
the VH of SEQ ID NO: 6 and the VL of SEQ ID NO: 2;
the VH of SEQ ID NO: 6 and the VL of SEQ ID NO: 3;
the VH of SEQ ID NO: 159 and the VL of SEQ ID NO: 160;
the VH of SEQ ID NO: 159 and the VL of SEQ ID NO: 140;
the VH of SEQ ID NO: 161 and the VL of SEQ ID NO: 140;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169; or
the VH of SEQ ID NO: 204 and the VL of SEQ ID NO: 205.

In some embodiments, the identity is 85%. In some embodiments, the identity is 90%. In some embodiments, the identity is 91%. In some embodiments, the identity is 91%. In some embodiments, the identity is 92%. In some embodiments, the identity is 93%. In some embodiments, the identity is 94%. In some embodiments, the identity is 94%. In some embodiments, the identity is 95%. In some embodiments, the identity is 96%. In some embodiments, the identity is 97%. In some embodiments, the identity is 98%. In some embodiments, the identity is 99%.

In some embodiments, the antigen binding domain that binds hK2 comprises a VH which is at least 80% (e.g. at least 85%, at least 90%, at least 95% or at least 99%) identical to the VH of SEQ ID NO: 137 and a VL which is at least 80% (e.g. at least 85%, at least 90%, at least 95% or at least 99%) identical to the VL of SEQ ID NO: 138.

In some embodiments, the antigen binding domain that binds hK2 comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163.

In some embodiments, the antigen binding domain that binds hK2 comprises a VH which is at least 80% (e.g. at least 85%, at least 90%, at least 95% or at least 99%) identical to the VH of SEQ ID NO: 164 and a VL which is at least 80% (e.g. at least 85%, at least 90%, at least 95% or at least 99%) identical to the VL of SEQ ID NO: 165.

In some embodiments, the antigen binding domain that binds hK2 comprises a VH which is at least 80% (e.g. at least 85%, at least 90%, at least 95% or at least 99%) identical to the VH of SEQ ID NO: 166 and a VL which is at least 80% (e.g. at least 85%, at least 90%, at least 95% or at least 99%) identical to the VL of SEQ ID NO: 167.

In some embodiments, the antigen binding domain that binds hK2 comprises a VH which is at least 80% (e.g. at least 85%, at least 90%, at least 95% or at least 99%) identical to the VH of SEQ ID NO: 166 and a VL which is at least 80% (e.g. at least 85%, at least 90%, at least 95% or at least 99%) identical to the VL of SEQ ID NO: 444.

In some embodiments, the antigen binding domain that binds hK2 comprises a VH which is at least 80% (e.g. at least 85%, at least 90%, at least 95% or at least 99%) identical to the VH of SEQ ID NO: 168 and a VL which is at least 80% (e.g. at least 85%, at least 90%, at least 95% or at least 99%) identical to the VL of SEQ ID NO: 169.

In some embodiments, the antigen binding domains that binds hK2 comprises a VH which is at least 80% (e.g. at least 85%, at least 90%, at least 95% or at least 99%) identical to the VH of SEQ ID NO: 204 and a VL which is at least 80% (e.g. at least 85%, at least 90%, at least 95% or at least 99%) identical to the VL of SEQ ID NO: 205.

In some embodiments, the antigen binding domain that binds hK2 comprises a VH which is at least 85% identical to the VH of SEQ ID NO: 162 and the VL of SEQ ID NO: 163.

In some embodiments, the antigen binding domain that binds hK2 comprises a VH which is at least 90% identical to the VH of SEQ ID NO: 162 and the VL of SEQ ID NO: 163.

In some embodiments, the antigen binding domain that binds hK2 comprises a VH which is at least 91% identical to the VH of SEQ ID NO: 162 and the VL of SEQ ID NO: 163.

In some embodiments, the antigen binding domain that binds hK2 comprises a VH which is at least 92% identical to the VH of SEQ ID NO: 162 and the VL of SEQ ID NO: 163.

In some embodiments, the antigen binding domain that binds hK2 comprises a VH which is at least 93% identical to the VH of SEQ ID NO: 162 and the VL of SEQ ID NO: 163.

In some embodiments, the antigen binding domain that binds hK2 comprises a VH which is at least 94% identical to the VH of SEQ ID NO: 162 and the VL of SEQ ID NO: 163.

In some embodiments, the antigen binding domain that binds hK2 comprises a VH which is at least 95% identical to the VH of SEQ ID NO: 162 and the VL of SEQ ID NO: 163.

In some embodiments, the antigen binding domain that binds hK2 comprises a VH which is at least 96% identical to the VH of SEQ ID NO: 162 and the VL of SEQ ID NO: 163.

In some embodiments, the antigen binding domain that binds hK2 comprises a VH which is at least 97% identical to the VH of SEQ ID NO: 162 and the VL of SEQ ID NO: 163.

In some embodiments, the antigen binding domain that binds hK2 comprises a VH which is at least 98% identical to the VH of SEQ ID NO: 162 and the VL of SEQ ID NO: 163.

In some embodiments, the antigen binding domain that binds hK2 comprises a VH which is at least 99% identical to the VH of SEQ ID NO: 162 and the VL of SEQ ID NO: 163.

In some embodiments, the antigen binding domain that binds hK2 comprises a VH of SEQ ID NO: 162 and a VL which is at least 85% identical to the VL of SEQ ID NO: 163

In some embodiments, the antigen binding domain that binds hK2 comprises a VH of SEQ ID NO: 162 and a VL which is at least 90% identical to the VL of SEQ ID NO: 163

In some embodiments, the antigen binding domain that binds hK2 comprises a VH of SEQ ID NO: 162 and a VL which is at least 91% identical to the VL of SEQ ID NO: 163

In some embodiments, the antigen binding domain that binds hK2 comprises a VH of SEQ ID NO: 162 and a VL which is at least 92% identical to the VL of SEQ ID NO: 163

In some embodiments, the antigen binding domain that binds hK2 comprises a VH of SEQ ID NO: 162 and a VL which is at least 93% identical to the VL of SEQ ID NO: 163

In some embodiments, the antigen binding domain that binds hK2 comprises a VH of SEQ ID NO: 162 and a VL which is at least 94% identical to the VL of SEQ ID NO: 163

In some embodiments, the antigen binding domain that binds hK2 comprises a VH of SEQ ID NO: 162 and a VL which is at least 95% identical to the VL of SEQ ID NO: 163

In some embodiments, the antigen binding domain that binds hK2 comprises a VH of SEQ ID NO: 162 and a VL which is at least 96% identical to the VL of SEQ ID NO: 163

In some embodiments, the antigen binding domain that binds hK2 comprises a VH of SEQ ID NO: 162 and a VL which is at least 97% identical to the VL of SEQ ID NO: 163

In some embodiments, the antigen binding domain that binds hK2 comprises a VH of SEQ ID NO: 162 and a VL which is at least 98% identical to the VL of SEQ ID NO: 163

In some embodiments, the antigen binding domain that binds hK2 comprises a VH of SEQ ID NO: 162 and a VL which is at least 99% identical to the VL of SEQ ID NO: 163

The percent identity between the two sequences is a function of the number of identical positions shared by the sequences (i.e., % identity=number of identical positions/ total number of positions×100), taking into account the number of gaps, and the length of each gap, which need to be introduced for optimal alignment of the two sequences.

The percent identity between two amino acid sequences may be determined using the algorithm of E. Meyers and W. Miller (*Comput Appl Biosci* 4:11-17 (1988)) which has been incorporated into the ALIGN program (version 2.0), using a PAM120 weight residue table, a gap length penalty of 12 and a gap penalty of 4. In addition, the percent identity between two amino acid or nucleic acid sequences may be determined using the Needleman and Wunsch *J Mol Biol* 48:444453 (1970)) algorithm which has been incorporated into the GAP program in the GCG software package (available at http_//_www_gcg_com), using either a Blossum 62 matrix or a PAM250 matrix, and a gap weight of 16, 14, 12, 10, 8, 6, or 4 and a length weight of 1, 2, 3, 4, 5, or 6.

In some embodiments, variant antigen binding domains that bind hK2 comprise one or two conservative substitutions in any of the CDR regions, while retaining desired functional properties of the parent antigen binding fragments that bind hK2.

"Conservative modifications" refer to amino acid modifications that do not significantly affect or alter the binding characteristics of the antibody containing the amino acid modifications. Conservative modifications include amino acid substitutions, additions and deletions. Conservative amino acid substitutions are those in which the amino acid is replaced with an amino acid residue having a similar side chain. The families of amino acid residues having similar side chains are well defined and include amino acids with acidic side chains (e.g., aspartic acid, glutamic acid), basic side chains (e.g., lysine, arginine, histidine), nonpolar side chains (e.g., alanine, valine, leucine, isoleucine, proline, phenylalanine, methionine), uncharged polar side chains (e.g., glycine, asparagine, glutamine, cysteine, serine, threonine, tyrosine, tryptophan), aromatic side chains (e.g., phenylalanine, tryptophan, histidine, tyrosine), aliphatic side chains (e.g., glycine, alanine, valine, leucine, isoleucine, serine, threonine), amide (e.g., asparagine, glutamine), beta-branched side chains (e.g., threonine, valine, isoleucine) and sulfur-containing side chains (cysteine, methionine). Furthermore, any native residue in the polypeptide may also be substituted with alanine, as has been previously described for alanine scanning mutagenesis (MacLennan et al., (1988) *Acta Physiol Scand Suppl* 643:55-67; Sasaki et al., (1988) *Adv Biophys* 35:1-24). Amino acid substitutions to the antibodies of the invention may be made by known methods for example by PCR mutagenesis (U.S. Pat. No. 4,683,195). Alternatively, libraries of variants may be generated for example using random (NNK) or non-random codons, for example DVK codons, which encode 11 amino acids (Ala, Cys, Asp, Glu, Gly, Lys, Asn, Arg, Ser, Tyr, Trp). The resulting variants may be tested for their characteristics using assays described herein.

Methods of Generating Antigen Binding Fragment that Bind hK2

Antigen binding domains that bind hK2 provided in the disclosure may be generated using various technologies. For example, the hybridoma method of Kohler and Milstein may be used to identify VH/VL pairs that bind hK2. In the hybridoma method, a mouse or other host animal, such as a hamster, rat or chicken is immunized with human and/or cyno hK2, followed by fusion of spleen cells from immunized animals with myeloma cells using standard methods to form hybridoma cells. Colonies arising from single immortalized hybridoma cells may be screened for production of the antibodies containing the antigen binding domains that bind hK2 with desired properties, such as specificity of binding, cross-reactivity or lack thereof, affinity for the antigen, and any desired functionality.

Antigen binding domains that bind hK2 generated by immunizing non-human animals may be humanized. Exemplary humanization techniques including selection of human acceptor frameworks include CDR grafting (U.S. Pat. No. 5,225,539), SDR grafting (U.S. Pat. No. 6,818,749). Resurfacing (Padlan, (1991) *Mol Immunol* 28:489-499), Specificity Determining Residues Resurfacing (U.S. Patent Publ. No. 2010/0261620), human framework adaptation (U.S. Pat. No. 8,748,356) or superhumanization (U.S. Pat. No. 7,709,226). In these methods. CDRs or a subset of CDR residues of parental antibodies are transferred onto human frameworks that may be selected based on their overall homology to the parental frameworks, based on similarity in CDR length, or canonical structure identity, or a combination thereof.

Humanized antigen binding domains may be further optimized to improve their selectivity or affinity to a desired antigen by incorporating altered framework support residues to preserve binding affinity (backmutations) by techniques such as those described in Int. Patent Publ. Nos. WO1090/007861 and WO1992/22653, or by introducing variation at any of the CDRs for example to improve affinity of the antigen binding domain.

Transgenic animals, such as mice, rat or chicken carrying human immunoglobulin (Ig) loci in their genome may be used to generate antigen binding fragments that bind hK2, and are described in for example U.S. Pat. No. 6,150,584, Int. Patent Pub. No. WO1999/45962, Int. Patent Pub. Nos. WO2002/066630, WO2002/43478, WO2002/043478 and WO1990/04036. The endogenous immunoglobulin loci in such animal may be disrupted or deleted, and at least one complete or partial human immunoglobulin locus may be inserted into the genome of the animal using homologous or non-homologous recombination, using transchromosomes, or using minigenes. Companies such as Regeneron (http://_www_regeneron_com), Harbour Antibodies (http://_www_harbourantibodies_com), Open Monoclonal Technology, Inc. (OMT) (http://_www_omtinc_net), KyMab (http://_www_kymab_com), Trianni (http://_www.trianni_com) and Ablexis (http://_www_ablexis_com) may be engaged to provide human antibodies directed against a selected antigen using technologies as described above. In some embodiments, Ablexis mice and OmniRats rats were immunized with soluble full length KLK2 protein (human Kallikrein-2 6-His protein) (SEQ ID NO: 454).

Antigen binding domains that bind hK2 may be selected from a phage display library, where the phage is engineered to express human immunoglobulins or portions thereof such as Fabs, single chain antibodies (scFv), or unpaired or paired antibody variable regions. The antigen binding domains that bind hK2 may be isolated for example from phage display library expressing antibody heavy and light chain variable regions as fusion proteins with bacteriophage pIX coat protein as described in Shi et al., (2010) *J Mol Biol* 397: 385-96, and Int. Patent Publ. No. WO09/085462). The libraries may be screened for phage binding to human and/or cyno hK2 and the obtained positive clones may be further characterized, the Fabs isolated from the clone lysates, and converted to scFvs or other configurations of antigen binding fragments.

Preparation of immunogenic antigens and expression and production of antigen binding domains of the disclosure may be performed using any suitable technique, such as recombinant protein production. The immunogenic antigens may be administered to an animal in the form of purified protein, or protein mixtures including whole cells or cell or tissue extracts, or the antigen may be formed de novo in the animal's body from nucleic acids encoding said antigen or a portion thereof.

Conjugation to Half-Life Extending Moieties

The antigen binding domains that bind hK2 of the disclosure may be conjugated to a half-life extending moiety. Exemplary half-life extending moieties are albumin, albumin variants, albumin-binding proteins and/or domains, transferrin and fragments and analogues thereof, immunoglobulins (Ig) or fragments thereof, such as Fc regions. Amino acid sequences of the aforementioned half-life extending moieties are known. Ig or fragments thereof include all isotypes, i.e., IgG1, IgG2, IgG3, IgG4, IgM, IgA and IgE.

Additional half-life extending moieties that may be conjugated to the antigen binding domains that bind hK2 of the disclosure include polyethylene glycol (PEG) molecules, such as PEG5000 or PEG20,000, fatty acids and fatty acid esters of different chain lengths, for example laurate, myristate, stearate, arachidate, behenate, oleate, arachidonate, octanedioic acid, tetradecanedioic acid, octadecanedioic acid, docosanedioic acid, and the like, polylysine, octane, carbohydrates (dextran, cellulose, oligo- or polysaccharides) for desired properties. These moieties may be direct fusions with the antigen binding domains that bind hK2 of the disclosure and may be generated by standard cloning and expression techniques. Alternatively, well known chemical coupling methods may be used to attach the moieties to recombinantly produced antigen binding domains that bind hK2 of the disclosure.

A pegyl moiety may for example be conjugated to the antigen binding domain that bind hK2 of the disclosure by incorporating a cysteine residue to the C-terminus of the antigen binding domain that bind hK2 of the disclosure, or engineering cysteines into residue positions that face away from the hK2 binding site and attaching a pegyl group to the cysteine using well known methods.

In some embodiments, the antigen binding fragment that binds hK2 is conjugated to a half-life extending moiety.

In some embodiments, the half-life extending moiety is an immunoglobulin (Ig), a fragment of the Ig, an Ig constant region, a fragment of the Ig constant region, a Fc region, transferrin, albumin, an albumin binding domain or polyethylene glycol. In some embodiments, the half-life extending moiety is an Ig constant region.

In some embodiments, the half-life extending moiety is the Ig.

In some embodiments, the half-life extending moiety is the fragment of the Ig.

In some embodiments, the half-life extending moiety is the Ig constant region.

In some embodiments, the half-life extending moiety is the fragment of the Ig constant region.

In some embodiments, the half-life extending moiety is the Fc region.

In some embodiments, the half-life extending moiety is albumin.

In some embodiments, the half-life extending moiety is the albumin binding domain.

In some embodiments, the half-life extending moiety is transferrin.

In some embodiments, the half-life extending moiety is polyethylene glycol.

The antigen binding domains that bind hK2 conjugated to a half-life extending moiety may be evaluated for their pharmacokinetic properties utilizing known in vivo models.

Conjugation to Immunoglobulin (Ig) Constant Regions or Fragments of the Ig Constant Regions The antigen binding domains that bind hK2 of the disclosure may be conjugated to an Ig constant region or a fragment of the Ig constant region to impart antibody-like properties, including Fc effector functions C1q binding, complement dependent cytotoxicity (CDC), Fc receptor binding, antibody-dependent cell-mediated cytotoxicity (ADCC), phagocytosis or down regulation of cell surface receptors (e.g., B cell receptor; BCR). The Ig constant region or the fragment of the Ig constant region functions also as a half-life extending moiety as discussed herein. The antigen binding domains that bind hK2 of the disclosure may be engineered into conventional full-length antibodies using standard methods. The full-length antibodies comprising the antigen binding domain that binds hK2 may further be engineered as described herein.

Immunoglobulin heavy chain constant region comprised of subdomains CH1, hinge, CH2 and CH3. The CH1 domain spans residues A118-V215, the CH2 domain residues A231-K340 and the CH3 domain residues G341-K447 on the heavy chain, residue numbering according to the EU Index. In some instances, G341 is referred as a CH2 domain residue. Hinge is generally defined as including E216 and terminating at P230 of human IgG1. Ig Fc region comprises at least the CH2 and the CH3 domains of the Ig constant region, and therefore comprises at least a region from about A231 to K447 of Ig heavy chain constant region.

The invention also provides an antigen binding domain that binds hK2 conjugated to an immunoglobulin (Ig) constant region or a fragment of the Ig constant region.

In some embodiments, the Ig constant region is a heavy chain constant region

In some embodiments, the Ig constant region is a light chain constant region.

In some embodiments, the fragment of the Ig constant region comprises a Fc region.

In some embodiments, the fragment of the Ig constant region comprises a CH2 domain.

In some embodiments, the fragment of the Ig constant region comprises a CH3 domain.

In some embodiments, the fragment of the Ig constant region comprises the CH2 domain and the CH3 domain.

In some embodiments, the fragment of the Ig constant region comprises at least portion of a hinge, the CH2 domain and the CH3 domain. Portion of the hinge refers to one or more amino acid residues of the Ig hinge.

In some embodiments, the fragment of the Ig constant region comprises the hinge, the CH2 domain and the CH3 domain.

In some embodiments, the antigen binding domain that binds hK2 is conjugated to the N-terminus of the Ig constant region or the fragment of the Ig constant region.

In some embodiments, the antigen binding domain that binds hK2 is conjugated to the C-terminus of the Ig constant region or the fragment of the Ig constant region.

In some embodiments, the antigen binding domain that binds hK2 is conjugated to the Ig constant region or the fragment of the Ig constant region via a second linker (L2).

In some embodiments, the L2 comprises the amino acid sequence of SEQ ID NOs: 7, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, or 108.

In some embodiments, the L2 comprises the amino acid sequence of SEQ ID NO: 7.

In some embodiments, the L2 comprises the amino acid sequence of SEQ ID NO: 76.

In some embodiments, the L2 comprises the amino acid sequence of SEQ ID NO: 77.

In some embodiments, the L2 comprises the amino acid sequence of SEQ ID NO: 78.

In some embodiments, the L2 comprises the amino acid sequence of SEQ ID NO: 79.

In some embodiments, the L2 comprises the amino acid sequence of SEQ ID NO: 80.

In some embodiments, the L2 comprises the amino acid sequence of SEQ ID NO: 81.

In some embodiments, the L2 comprises the amino acid sequence of SEQ ID NO: 82.

In some embodiments, the L2 comprises the amino acid sequence of SEQ ID NO: 83.

In some embodiments, the L2 comprises the amino acid sequence of SEQ ID NO: 84.

In some embodiments, the L2 comprises the amino acid sequence of SEQ ID NO: 85.

In some embodiments, the L2 comprises the amino acid sequence of SEQ ID NO: 86.

In some embodiments, the L2 comprises the amino acid sequence of SEQ ID NO: 87.

In some embodiments, the L2 comprises the amino acid sequence of SEQ ID NO: 88.

In some embodiments, the L2 comprises the amino acid sequence of SEQ ID NO: 89.

In some embodiments, the L2 comprises the amino acid sequence of SEQ ID NO: 90.

In some embodiments, the L2 comprises the amino acid sequence of SEQ ID NO: 91.

In some embodiments, the L2 comprises the amino acid sequence of SEQ ID NO: 92.

In some embodiments, the L2 comprises the amino acid sequence of SEQ ID NO: 93.

In some embodiments, the L2 comprises the amino acid sequence of SEQ ID NO: 94.

In some embodiments, the L2 comprises the amino acid sequence of SEQ ID NO: 95.

In some embodiments, the L2 comprises the amino acid sequence of SEQ ID NO: 96.

In some embodiments, the L2 comprises the amino acid sequence of SEQ ID NO: 97.

In some embodiments, the L2 comprises the amino acid sequence of SEQ ID NO: 98.

In some embodiments, the L2 comprises the amino acid sequence of SEQ ID NO: 99.

In some embodiments, the L2 comprises the amino acid sequence of SEQ ID NO: 100.

In some embodiments, the L2 comprises the amino acid sequence of SEQ ID NO: 101.

In some embodiments, the L2 comprises the amino acid sequence of SEQ ID NO: 102.

In some embodiments, the L2 comprises the amino acid sequence of SEQ ID NO: 103.

In some embodiments, the L2 comprises the amino acid sequence of SEQ ID NO: 104.

In some embodiments, the L2 comprises the amino acid sequence of SEQ ID NO: 105.

In some embodiments, the L2 comprises the amino acid sequence of SEQ ID NO: 106.

In some embodiments, the L2 comprises the amino acid sequence of SEQ ID NO: 107.

In some embodiments, the L2 comprises the amino acid sequence of SEQ ID NO: 108.

The antigen binding domains that binds hK2 of the disclosure conjugated to Ig constant region or the fragment of the Ig constant region may be assessed for their functionality using several known assays. Binding to hK2 may be assessed using methods described herein. Altered properties imparted by the Ig constant domain or the fragment of the Ig constant region such as Fc region may be assayed in Fc receptor binding assays using soluble forms of the receptors, such as the FcγRI, FcγRII, FcγRIII or FcRn receptors, or using cell-based assays measuring for example ADCC, CDC or ADCP.

ADCC may be assessed using an in vitro assay using hK2 expressing cells as target cells and NK cells as effector cells. Cytolysis may be detected by the release of label (e.g. radioactive substrates, fluorescent dyes or natural intracellular proteins) from the lysed cells. In an exemplary assay, target cells are used with a ratio of 1 target cell to 4 effector cells. Target cells are pre-labeled with BATDA and combined with effector cells and the test antibody. The samples are incubated for 2 hours and cell lysis measured by measuring released BATDA into the supernatant. Data is normalized to maximal cytotoxicity with 0.67% Triton X-100 (Sigma Aldrich) and minimal control determined by spontaneous release of BATDA from target cells in the absence of any antibody.

ADCP may be evaluated by using monocyte-derived macrophages as effector cells and any hK2 expressing cells as target cells which are engineered to express GFP or other labeled molecule. In an exemplary assay, effector:target cell ratio may be for example 4:1. Effector cells may be incubated with target cells for 4 hours with or without the antibody of the invention. After incubation, cells may be detached using accutase. Macrophages may be identified with anti-CD11b and anti-CD14 antibodies coupled to a fluorescent label, and percent phagocytosis may be determined based on % GFP fluorescence in the CD11$^+$CD14$^+$ macrophages using standard methods.

CDC of cells may be measured for example by plating Daudi cells at 1×10$^5$ cells/well (50 μL/well) in RPMI-B (RPMI supplemented with 1% BSA), adding 50 μL of test protein to the wells at final concentration between 0-100 μg/mL, incubating the reaction for 15 min at room temperature, adding 11 μL of pooled human serum to the wells, and incubation the reaction for 45 min at 37° C. Percentage (%) lysed cells may be detected as % propidium iodide stained cells in FACS assay using standard methods.

In some embodiments, the antigen binding domain that binds hK2 is conjugated to an IgG1 heavy chain constant region or a fragment of the IgG1 heavy chain constant region. In some embodiments, the antigen binding domain that binds hK2 is conjugated to an IgG1 heavy chain constant region or a fragment of the IgG1 heavy chain constant region (e.g. comprising the hinge-CH2-CH3) comprising an amino acid sequence which is at least 80% (e.g. at least 85%, at least 90%, at least 95% or at least 99%) identical to SEQ ID NO: 110. In some embodiments, the IgG1 heavy chain constant region comprises the Fc silencing mutation (L234A_L235A_D265S) and the T350V_T366L_K392L_T394W mutations designed to promote selective heterodimerization. In some embodiments, the antigen binding domain that binds hK2 is conjugated to an IgG1 heavy chain constant region or a fragment of the IgG1 heavy chain constant region having the amino acid sequence of SEQ ID NO: 110.

In some embodiments, the antigen binding domain that binds hK2 is conjugated to an IgG1 heavy chain constant region (e.g. CH1-hinge-CH2-CH3) comprising an amino acid sequence which is at least 80% (e.g. at least 85%, at least 90%, at least 95% or at least 99%) identical to the amino acid sequence of SEQ ID NO: 378. In a particular embodiment, the antigen binding domain that binds hK2 is conjugated to an IgG1 heavy chain constant region or a fragment of the IgG1 heavy chain constant region comprising the amino acid sequence of SEQ ID NO: 378.

In some embodiments, the antigen binding domain that binds hK2 is conjugated to an IgG1 light chain constant region comprising an amino acid sequence which is at least 80% (e.g. at least 85%, at least 90%, at least 95% or at least 99%) identical to SEQ ID NO: 309. In some embodiments, the antigen binding domain that binds hK2 is conjugated to an IgG1 light chain constant region comprising an amino acid sequence which is at least 80% (e.g. at least 85%, at least 90%, at least 95% or at least 99%) identical to SEQ ID NO: 447. In some embodiments, the antigen binding domain that binds hK2 is conjugated to an IgG1 light chain constant region comprising an amino acid sequence which is identical to SEQ ID NO: 309 or 447. In a particular embodiment, the antigen binding domain that binds hK2 is conjugated to an IgG1 light chain constant region comprising an amino acid sequence which is identical to SEQ ID NO: 309.

In a particular embodiment, the isolated protein disclosed herein comprises an antigen binding domain that binds hK2 which is conjugated to an IgG1 heavy chain constant region comprising the amino acid sequence of SEQ ID NO: 378 and an antigen binding domain that binds hK2 which is conjugated to an IgG1 light chain constant region comprising an amino acid sequence which is identical to SEQ ID NO: 309.

In a particular embodiment, the isolated protein disclosed herein comprises a first antigen binding domain that binds hK2 and a first Ig heavy chain constant region or fragment of a first Ig heavy chain constant region comprising an amino acid sequence which is identical to SEQ ID NO: 378.

In a particular embodiment, the isolated protein disclosed herein comprises a first antigen binding domain that binds hK2 and a first Ig light chain constant region or fragment of a first Ig light chain constant region comprising an amino acid sequence which is identical to SEQ ID NO: 309.

In a particular embodiment, the isolated protein disclosed herein comprises a first antigen binding domain that binds hK2 and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309.

In a particular embodiment, the isolated protein disclosed herein comprises a second antigen binding domain that binds a lymphocyte antigen (e.g. CD3) and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2 and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309, and wherein the isolated protein further comprises a second antigen binding domain that binds a lymphocyte antigen (e.g. CD3) and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and a first Ig heavy chain constant region or fragment of a first Ig heavy chain constant region comprising an amino acid sequence which is identical to SEQ ID NO: 378.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and a first Ig light chain constant region or fragment of a first Ig light chain constant region comprising an amino acid sequence which is identical to SEQ ID NO: 309.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309.

In a particular embodiment, the isolated protein disclosed herein comprises a second antigen binding domain that binds a lymphocyte antigen (e.g. CD3), wherein the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261, and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309, and wherein the isolated protein further comprises a second antigen binding domain that binds a lymphocyte antigen (e.g. CD3), wherein the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261, and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and a first Ig heavy chain constant region or fragment of a first Ig heavy chain constant region comprising an amino acid sequence which is identical to SEQ ID NO: 378.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and a first Ig light chain constant region or fragment of a first Ig light chain constant region comprising an amino acid sequence which is identical to SEQ ID NO: 309.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309.

In a particular embodiment, the isolated protein disclosed herein comprises a second antigen binding domain that binds a lymphocyte antigen (e.g. CD3), wherein the second antigen binding domain that binds a lymphocyte antigen comprises the amino acid sequence of SEQ ID NO: 331, and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309, and wherein the isolated protein further comprises a second antigen binding domain that binds a lymphocyte antigen (e.g. CD3), wherein the second antigen binding domain that binds a lymphocyte antigen comprises the amino acid sequence of SEQ ID NO: 331, and a second Ig constant region or a fragment of a second Ig constant region comprising an amino acid sequence which is identical to SEQ ID NO: 109.

Proteins Comprising the Antigen Binding Domains that Bind hK2 of the Disclosure

The antigen binding domains that bind hK2 of the disclosure may be engineered into monospecific or multispecific proteins of various designs using standard methods.

The disclosure also provides a monospecific protein comprising the antigen binding domain that binds hK2 of the disclosure.

In some embodiments, the monospecific protein is an antibody.

The disclosure also provides a multispecific protein comprising the antigen binding domain that binds hK2 of the disclosure.

In some embodiments, the multispecific protein is bispecific.

In some embodiments, the multispecific protein is trispecific.

In some embodiments, the multispecific protein is tetraspecific.

In some embodiments, the multispecific protein is monovalent for binding to hK2.

In some embodiments, the multispecific protein is bivalent for binding to hK2.

The disclosure also provides an isolated multispecific protein comprising a first antigen binding domain that binds hK2 and a second antigen binding domain that binds a lymphocyte antigen (such as CD3).

In some embodiments, the lymphocyte antigen is a T cell antigen.

In some embodiments, the T cell antigen is a CD8⁺ T cell antigen.

In some embodiments, the lymphocyte antigen is a NK cell antigen.

In some embodiments, the lymphocyte antigen is CD3, CD3 epsilon (CD3ε), CD8, K12L4, NKG2E, NKG2D, NKG2F, BTNL3, CD186, BTNL8, PD-1, CD195, or NKG2C.

In some embodiments, the lymphocyte antigen is CD3ε.

In some embodiments the isolated multispecific protein is an anti-hK2/anti-CD3 protein.

In some embodiments the anti-hK2/anti-CD3 protein is bispecific.

In some embodiments, the first antigen binding domain that binds hK2 and/or the second antigen binding domain that binds the lymphocyte antigen comprise a scFv, a (scFv)$_2$, a Fv, a Fab, a F(ab')$_2$, a Fd, a dAb or a VHH.

In some embodiments, the first antigen binding domain that binds hK2 and/or the second antigen binding domain that binds the lymphocyte antigen comprise the Fab.

In particular embodiments, the first antigen binding domain that binds hK2 comprises the Fab.

In some embodiments, the second antigen binding domain that binds the lymphocyte antigen comprises the Fab.

In some embodiments, the first antigen binding domain that binds hK2 and/or the second antigen binding domain that binds the lymphocyte antigen comprise the F(ab')$_2$.

In some embodiments, the first antigen binding domain that binds hK2 comprises the F(ab')$_2$.

In some embodiments, the second antigen binding domain that binds the lymphocyte antigen comprise the F(ab')$_2$.

In some embodiments, the first antigen binding domain that binds hK2 and/or the second antigen binding domain that binds the lymphocyte antigen comprise the VHH.

In some embodiments, the first antigen binding domain that binds hK2 comprises the VHH.

In some embodiments, the second antigen binding domain that binds the lymphocyte antigen comprises the VHH.

In some embodiments, the first antigen binding domain that binds hK2 and/or the second antigen binding domain that binds the lymphocyte antigen comprise the Fv.

In some embodiments, the first antigen binding domain that binds hK2 comprises the Fv.

In some embodiments, the second antigen binding domain that binds the lymphocyte antigen comprises the Fv.

In some embodiments, the first antigen binding domain that binds hK2 and/or the second antigen binding domain that binds the lymphocyte antigen comprise the Fd.

In some embodiments, the first antigen binding domain that binds hK2 comprises the Fd.

In some embodiments, the second antigen binding domain that binds the lymphocyte antigen comprises the Fd.

In some embodiments, the first antigen binding domain that binds hK2 and/or the second antigen binding domain that binds the lymphocyte antigen comprise the scFv.

In a particular embodiment, the multispecific protein is bispecific, wherein the first antigen binding domain that binds hK2 comprises a Fab and the second antigen binding domain that binds the lymphocyte antigen (e.g. CD3) comprises a scFv.

In some embodiments, the first antigen binding domain that binds comprises the scFv.

In some embodiments, the second antigen binding domain that binds the lymphocyte antigen comprises the scFv.

In some embodiments, the first antigen binding domain that binds hK2 comprises a scFv and the second antigen binding domain that binds the lymphocyte antigen comprises a Fab.

In a particular embodiment, the first antigen binding domain that binds hK2 comprises a Fab and the second antigen binding domain that binds the lymphocyte antigen comprises a scFv.

In some embodiments, the first antigen binding domain that binds hK2 comprises a scFv and the second antigen binding domain that binds the lymphocyte antigen comprises a Fab'.

In some embodiments, the first antigen binding domain that binds hK2 comprises a Fab' and the second antigen binding domain that binds the lymphocyte antigen comprises a scFv.

In some embodiments, the first antigen binding domain that binds hK2 comprises a scFv and the second antigen binding domain that binds the lymphocyte antigen comprises a Fv.

In some embodiments, the first antigen binding domain that binds hK2 comprises a dAb and the second antigen binding domain that binds the lymphocyte antigen comprises a scFv.

In some embodiments, the first antigen binding domain that binds hK2 comprises a scFv and the second antigen binding domain that binds the lymphocyte antigen comprises a dAb.

In some embodiments, the first antigen binding domain that binds hK2 comprises a Fd and the second antigen binding domain that binds the lymphocyte antigen comprises a scFv.

In some embodiments, the first antigen binding domain that binds hK2 comprises a scFv and the second antigen binding domain that binds the lymphocyte antigen comprises a VHH.

In some embodiments, the first antigen binding domain that binds hK2 comprises a VHH and the second antigen binding domain that binds the lymphocyte antigen comprises a scFv.

In some embodiments, the first antigen binding domain that binds hK2 comprises a Fv and the second antigen binding domain that binds the lymphocyte antigen comprises a scFv.

In some embodiments, the first antigen binding domain that binds hK2 comprises a scFv and the second antigen binding domain that binds the lymphocyte antigen comprises a Fd.

In some embodiments, the scFv comprises, from the N- to C-terminus, a VH, a first linker (L1) and a VL (VH-L1-VL) or the VL, the L1 and the VH (VL-L1-VH).

In some embodiments, the L comprises about 5-50 amino acids.

In some embodiments, the L1 comprises about 5-40 amino acids.

In some embodiments, the L1 comprises about 10-30 amino acids.

In some embodiments, the L1 comprises about 10-20 amino acids.

In some embodiments, the L1 comprises the amino acid sequence of SEQ ID NOs: 7, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, or 108.

In some embodiments, the L1 comprises the amino acid sequence of SEQ ID NO: 7.

In some embodiments, the L1 comprises the amino acid sequence of SEQ ID NO: 76.

In some embodiments, the L1 comprises the amino acid sequence of SEQ ID NO: 77.

In some embodiments, the L1 comprises the amino acid sequence of SEQ ID NO: 78.

In some embodiments, the L1 comprises the amino acid sequence of SEQ ID NO: 79.

In some embodiments, the L1 comprises the amino acid sequence of SEQ ID NO: 80.

In some embodiments, the L1 comprises the amino acid sequence of SEQ ID NO: 81.

In some embodiments, the L1 comprises the amino acid sequence of SEQ ID NO: 82.

In some embodiments, the L1 comprises the amino acid sequence of SEQ ID NO: 83.

In some embodiments, the L1 comprises the amino acid sequence of SEQ ID NO: 84.

In some embodiments, the L1 comprises the amino acid sequence of SEQ ID NO: 85.

In some embodiments, the L1 comprises the amino acid sequence of SEQ ID NO: 86.

In some embodiments, the L1 comprises the amino acid sequence of SEQ ID NO: 87.

In some embodiments, the L1 comprises the amino acid sequence of SEQ ID NO: 88.

In some embodiments, the L1 comprises the amino acid sequence of SEQ ID NO: 89.

In some embodiments, the L1 comprises the amino acid sequence of SEQ ID NO: 90.

In some embodiments, the L1 comprises the amino acid sequence of SEQ ID NO: 91.

In some embodiments, the L1 comprises the amino acid sequence of SEQ ID NO: 92.

In some embodiments, the L1 comprises the amino acid sequence of SEQ ID NO: 93.

In some embodiments, the L1 comprises the amino acid sequence of SEQ ID NO: 94.

In some embodiments, the L1 comprises the amino acid sequence of SEQ ID NO: 95.

In some embodiments, the L1 comprises the amino acid sequence of SEQ ID NO: 96.

In some embodiments, the L1 comprises the amino acid sequence of SEQ ID NO: 97.

In some embodiments, the L1 comprises the amino acid sequence of SEQ ID NO: 98.

In some embodiments, the L1 comprises the amino acid sequence of SEQ ID NO: 99.

In some embodiments, the L1 comprises the amino acid sequence of SEQ ID NO: 100.

In some embodiments, the L1 comprises the amino acid sequence of SEQ ID NO: 101.

In some embodiments, the L1 comprises the amino acid sequence of SEQ ID NO: 102.

In some embodiments, the L1 comprises the amino acid sequence of SEQ ID NO: 103.

In some embodiments, the L1 comprises the amino acid sequence of SEQ ID NO: 104.

In some embodiments, the L1 comprises the amino acid sequence of SEQ ID NO: 105.

In some embodiments, the L1 comprises the amino acid sequence of SEQ ID NO: 106.

In some embodiments, the L1 comprises the amino acid sequence of SEQ ID NO: 107.

In some embodiments, the L1 comprises the amino acid sequence of SEQ ID NO: 108.

In a particular embodiment, the L1 comprises the amino acid sequence of SEQ ID NO: 7.

In some embodiments, the first antigen binding domain that binds hK2 comprises the HCDR1 of SEQ ID NOs: 63, 72, 141, 147, 170, 176, 188, 194, 196, 198, 200, 206, or 216, the HCDR2 of SEQ ID NOs: 64, 65, 73, 142, 148, 171, 177, 188, 189, 195, 197, 199, 201, 207, or 217, the HCDR3 of SEQ ID NOs: 66, 143, 172, 178, 184, 190, 208, or 218, the LCDR1 of SEQ ID NOs: 67, 68, 144, 173, 179, 182, 185 or 191, the LCDR2 of SEQ ID NOs: 69, 70, 145, 174, 180, 186, 192, or 470 and the LCDR3 of SEQ ID NOs: 71, 146, 175, 181, 187, 193, or 209.

In some embodiments, the first antigen binding domain that binds hK2 comprises the HCDR1, the HCDR2, the HCDR3, the LCDR1, the LCDR2 and the LCDR3 of
SEQ ID NOs: 63, 65, 66, 68, 70 and 71, respectively;
SEQ ID NOs: 63, 64, 66, 67, 69 and 71, respectively;
SEQ ID NOs: 63, 65, 66, 67, 69 and 71, respectively;
SEQ ID NOs: 141, 142, 143, 144, 145 and 146, respectively;
SEQ ID Nos: 170, 171, 172, 173, 174 and 175, respectively;
SEQ ID NO: 176, 177, 178, 179, 180 and 181, respectively;
SEQ ID NO: 170, 183, 184, 185, 186 and 187, respectively;
SEQ ID NO: 188, 189, 190, 191, 192 and 193, respectively;
SEQ ID NO: 206, 207, 208, 182, 470 and 209, respectively;
SEQ ID NOs: 147, 148, 143, 144, 145 and 146, respectively;
SEQ ID NOs: 72, 73, 66, 68, 70 and 71, respectively;
SEQ ID NOs: 72, 73, 66, 67, 69 and 71, respectively;
SEQ ID NO: 194, 195, 172, 173, 174 and 175, respectively;
SEQ ID NO: 196, 197, 178, 179, 190 and 181 respectively;
SEQ ID NO: 198, 199, 184, 185, 186 and 187, respectively;

SEQ ID NO: 200, 201, 190, 191, 192 and 193 respectively; or

SEQ ID NO: 216, 217, 218, 182, 470, and 209 respectively.

In a particular embodiment, the first antigen binding domain that binds hK2 comprises the HCDR1, the HCDR2, the HCDR3, the LCDR1, the LCDR2 and the LCDR3 of SEQ ID NOs: 170, 171, 172, 173, 174 and 175, respectively or of SEQ ID NOs: 194, 195, 172, 173, 174, and 175, respectively.

In a particular embodiment, the first antigen binding domain that binds hK2 comprises the HCDR1, the HCDR2, the HCDR3, the LCDR1, the LCDR2 and the LCDR3 of SEQ ID NOs: 170, 171, 172, 173, 174 and 175, respectively, and the second antigen binding domain that binds a lymphocyte antigen, optionally which is CD3, CD3 epsilon (CD3F), CD8, K12L4, NKG2E, NKG2D, NKG2F, BTNL3, CD186, BTNL8, PD-1, CD195, or NKG2C, such as CD3.

In a particular embodiment, the first antigen binding domain that binds hK2 comprises the HCDR1, the HCDR2, the HCDR3, the LCDR1, the LCDR2 and the LCDR3 of SEQ ID NOs: 194, 195, 172, 173, 174, and 175, respectively, and the second antigen binding domain that binds a lymphocyte antigen, optionally which is CD3, CD3 epsilon (CD3ε), CD8, K12L4, NKG2E, NKG2D, NKG2F, BTNL3, CD186, BTNL8, PD-1, CD195, or NKG2C, such as CD3.

In some embodiments, the first antigen binding domain that binds hK2 comprises the VH of SEQ ID NO: 137 and the VL of SEQ ID NO: 138.

In some embodiments, the first antigen binding domain that binds hK2 comprises the VH of SEQ ID NO: 162 and the VL of SEQ ID NO: 163.

In some embodiments, the first antigen binding domain that binds hK2 comprises the VH of SEQ ID NO: 164 and the VL of SEQ ID NO: 165.

In some embodiments, the first antigen binding domain that binds hK2 comprises the VH of SEQ ID NO: 166 and the VL of SEQ ID NO: 167.

In some embodiments, the first antigen binding domain that binds hK2 comprises the VH of SEQ ID NO: 168 and the VL of SEQ ID NO: 169.

In some embodiments, the first antigen binding domain that binds hK2 comprises the VH of SEQ ID NO: 204 and the VL of SEQ ID NO: 205.

In some embodiments, the first antigen binding domain that binds hK2 comprises the VH of SEQ ID NO: 75 and the VL of SEQ ID NO: 74.

In some embodiments, the first antigen binding domain that binds hK2 comprises the VH of SEQ ID NO: 75 and the VL of SEQ ID NO: 74.

In some embodiments, the first antigen binding domain that binds hK2 comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163.

In some embodiments, the first antigen binding domain that binds hK2 comprises a VH which is at least 80% (e.g. at least 85%, at least 90%, at least 95% or at least 99%) identical to the VH of SEQ ID NO: 162 and a VL of SEQ ID NO: 163.

In some embodiments, the first antigen binding domain that binds hK2 comprises a VH of SEQ ID NO: 162 and a VL which is at least 80% (e.g. at least 85%, at least 90%, at least 95% or at least 99%) identical to the VL of SEQ ID NO: 163.

In some embodiments, the first antigen binding domain that binds hK2 comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163 and the second antigen binding domain that binds a lymphocyte antigen, optionally which is CD3, CD3 epsilon (CD3ε), CD8, K12L4, NKG2E, NKG2D, NKG2F, BTNL3, CD186, BTNL8, PD-1, CD195, or NKG2C, such as CD3.

In some embodiments, the first antigen binding domain that binds hK2 comprises a VH which is at least 80% (e.g. at least 85%, at least 90%, at least 95% or at least 99%) identical to the VH of SEQ ID NO: 162 and a VL of SEQ ID NO: 163, and the second antigen binding domain that binds a lymphocyte antigen, optionally which is CD3, CD3 epsilon (CD3ε), CD8, K12L4, NKG2E, NKG2D, NKG2F, BTNL3, CD186, BTNL8, PD-1, CD195, or NKG2C, such as CD3.

In some embodiments, the first antigen binding domain that binds hK2 comprises a VH of SEQ ID NO: 162 and a VL which is at least 80% (e.g. at least 85%, at least 90%, at least 95% or at least 99%) identical to the VL of SEQ ID NO: 163, and the second antigen binding domain that binds a lymphocyte antigen, optionally which is CD3, CD3 epsilon (CD3ε), CD8, K12L4, NKG2E, NKG2D, NKG2F, BTNL3, CD186, BTNL8, PD-1, CD195, or NKG2C, such as CD3.

In a particular embodiment, the first antigen binding domain that binds hK2 comprises the VH of SEQ ID NO: 162 and the VL of SEQ ID NO: 163.

In a particular embodiment, the first antigen binding domain that binds hK2 comprises the VH of SEQ ID NO: 162 and the VL of SEQ ID NO: 163, and the second antigen binding domain that binds a lymphocyte antigen, optionally which is CD3, CD3 epsilon (CD3ε), CD8, KI2L4, NKG2E, NKG2D, NKG2F, BTNL3, CD186, BTNL8, PD-1, CD195, or NKG2C, such as CD3.

In some embodiments, the first antigen binding domain that binds hK2 comprises the VH of SEQ ID NOs: 4, 5, 6, 139, 159 or 161 and the VL of SEQ ID NOs: 1, 2, 3, 140 or 160, with the proviso that the Fab does not comprise the VH of SEQ ID NO: 5 and the VL of SEQ ID NO: 2.

In some embodiments, the first antigen binding domain that binds hK2 comprises the VH of SEQ ID NOs: 4, 5 or 6 and the VL of SEQ ID NOs: 1, 2 or 3, with the proviso that the first antigen binding domain that binds hK2 does not comprise the VH of SEQ ID NO: 5 and the VL of SEQ ID NO: 2.

In some embodiments, the first antigen binding domain that binds hK2 comprises:
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 4 and the VL of SEQ ID NO: 140;
the VH of SEQ ID NO: 4 and the VL of SEQ ID NO: 160;
the VH of SEQ ID NO: 5 and the VL of SEQ ID NO: 1;
the VH of SEQ ID NO: 5 and the VL of SEQ ID NO: 3;
the VH of SEQ ID NO: 5 and the VL of SEQ ID NO: 140;
the VH of SEQ ID NO: 5 and the VL of SEQ ID NO: 160;
the VH of SEQ ID NO: 6 and the VL of SEQ ID NO: 1;
the VH of SEQ ID NO: 6 and the VL of SEQ ID NO: 2;
the VH of SEQ ID NO: 6 and the VL of SEQ ID NO: 3;
the VH of SEQ ID NO: 6 and the VL of SEQ ID NO: 140;
the VH of SEQ ID NO: 6 and the VL of SEQ ID NO: 160;
the VH of SEQ ID NO: 139 and the VL of SEQ ID NO: 1;
the VH of SEQ ID NO: 139 and the VL of SEQ ID NO: 2;
the VH of SEQ ID NO: 139 and the VL of SEQ ID NO: 3;
the VH of SEQ ID NO: 139 and the VL of SEQ ID NO: 140;

the VH of SEQ ID NO: 139 and the VL of SEQ ID NO: 160;
the VH of SEQ ID NO: 159 and the VL of SEQ ID NO: 1;
the VH of SEQ ID NO: 159 and the VL of SEQ ID NO: 2;
the VH of SEQ ID NO: 159 and the VL of SEQ ID NO: 3;
the VH of SEQ ID NO: 159 and the VL of SEQ ID NO: 140;
the VH of SEQ ID NO: 159 and the VL of SEQ ID NO: 160;
the VH of SEQ ID NO: 161 and the VL of SEQ ID NO: 1;
the VH of SEQ ID NO: 161 and the VL of SEQ ID NO: 2;
the VH of SEQ ID NO: 161 and the VL of SEQ ID NO: 3;
the VH of SEQ ID NO: 161 and the VL of SEQ ID NO: 140;
or
the VH of SEQ ID NO: 161 and the VL of SEQ ID NO: 160.

In some embodiments, the first antigen binding domain that binds hK2 comprises the amino acid sequence of SEQ ID NOs: 8, 9, 10, 11, 12, 13, 14, 15, 16, 17, 18, 19, 20, 21, 22, 23, 133, 134, 135, 136, 308, 316, 318, 319, 320, 321, 322, 323, 324, 325, 404, 405, 406, 407, 408, or 409.

In some embodiments, the first antigen binding domain that binds hK2 comprises the amino acid sequence of SEQ ID NO: 8.

In some embodiments, the first antigen binding domain that binds hK2 comprises the amino acid sequence of SEQ ID NO: 9.

In some embodiments, the first antigen binding domain that binds hK2 comprises the amino acid sequence of SEQ ID NO: 10.

In some embodiments, the first antigen binding domain that binds hK2 comprises the amino acid sequence of SEQ ID NO: 11.

In some embodiments, the first antigen binding domain that binds hK2 comprises the amino acid sequence of SEQ ID NO: 12.

In some embodiments, the first antigen binding domain that binds hK2 comprises the amino acid sequence of SEQ ID NO: 13.

In some embodiments, the first antigen binding domain that binds hK2 comprises the amino acid sequence of SEQ ID NO: 14.

In some embodiments, the first antigen binding domain that binds hK2 comprises the amino acid sequence of SEQ ID NO: 15.

In some embodiments, the first antigen binding domain that binds hK2 comprises the amino acid sequence of SEQ ID NO: 16.

In some embodiments, the first antigen binding domain that binds hK2 comprises the amino acid sequence of SEQ ID NO: 17.

In some embodiments, the first antigen binding domain that binds hK2 comprises the amino acid sequence of SEQ ID NO: 18.

In some embodiments, the first antigen binding domain that binds hK2 comprises the amino acid sequence of SEQ ID NO: 19.

In some embodiments, the first antigen binding domain that binds hK2 comprises the amino acid sequence of SEQ ID NO: 20.

In some embodiments, the first antigen binding domain that binds hK2 comprises the amino acid sequence of SEQ ID NO: 21.

In some embodiments, the first antigen binding domain that binds hK2 comprises the amino acid sequence of SEQ ID NO: 22.

In some embodiments, the first antigen binding domain that binds hK2 comprises the amino acid sequence of SEQ ID NO: 23.

In some embodiments, the first antigen binding domain that binds hK2 comprises the amino acid sequence of SEQ ID NO: 133.

In some embodiments, the first antigen binding domain that binds hK2 comprises the amino acid sequence of SEQ ID NO: 134.

In some embodiments, the first antigen binding domain that binds hK2 comprises the amino acid sequence of SEQ ID NO: 135.

In some embodiments, the first antigen binding domain that binds hK2 comprises the amino acid sequence of SEQ ID NO: 136.

In some embodiments, the first antigen binding domain that binds hK2 comprises the amino acid sequence of SEQ ID NO: 308.

In some embodiments, the first antigen binding domain that binds hK2 comprises the amino acid sequence of SEQ ID NO: 316.

In some embodiments, the first antigen binding domain that binds hK2 comprises the amino acid sequence of SEQ ID NO: 318.

In some embodiments, the first antigen binding domain that binds hK2 comprises the amino acid sequence of SEQ ID NO: 319.

In some embodiments, the first antigen binding domain that binds hK2 comprises the amino acid sequence of SEQ ID NO: 320.

In some embodiments, the first antigen binding domain that binds hK2 comprises the amino acid sequence of SEQ ID NO: 321.

In some embodiments, the first antigen binding domain that binds hK2 comprises the amino acid sequence of SEQ ID NO: 322.

In some embodiments, the first antigen binding domain that binds hK2 comprises the amino acid sequence of SEQ ID NO: 323.

In some embodiments, the first antigen binding domain that binds hK2 comprises the amino acid sequence of SEQ ID NO: 324.

In some embodiments, the first antigen binding domain that binds hK2 comprises the amino acid sequence of SEQ ID NO: 325.

In some embodiments, the first antigen binding domain that binds hK2 comprises the amino acid sequence of SEQ ID NO: 404.

In some embodiments, the first antigen binding domain that binds hK2 comprises the amino acid sequence of SEQ ID NO: 405.

In some embodiments, the first antigen binding domain that binds hK2 comprises the amino acid sequence of SEQ ID NO: 406.

In some embodiments, the first antigen binding domain that binds hK2 comprises the amino acid sequence of SEQ ID NO: 407.

In some embodiments, the first antigen binding domain that binds hK2 comprises the amino acid sequence of SEQ ID NO: 408.

In some embodiments, the first antigen binding domain that binds hK2 comprises the amino acid sequence of SEQ ID NO: 409.

In some embodiments, the first antigen binding domain that binds hK2 comprises an amino acid sequence at least 80% (e.g. at least 85%, at least 90%, at least 95% or at least 99%) identical to the amino acid sequence of SEQ ID NO: 404, In some embodiments, the first antigen binding domain that binds hK2 comprises an amino acid sequence at least 80% (e.g. at least 85%, at least 90%, at least 95% or at least 99%) identical to the amino acid sequence of SEQ ID NO: 405.

In a particular embodiment, the first antigen binding domain that binds hK2 comprises an amino acid sequence of SEQ ID NO: 404 or 405. The disclosure also provides a second binding domain that binds lymphocyte antigen, wherein the antigen binding domain that binds lymphocyte comprises the heavy chain variable region (VH) of SEQ ID NO: 248 and the light chain variable region (VL) of SEQ ID NO: 157. SEQ ID NO: 248 and SEQ ID NO: 157 represent genus VH and VL amino acid sequences of the parent antibody CD3B815 antibody.

```
VL consensus
                                   (SEQ ID NO: 157)
DIQX₁TQSPX₂X₃LSX₄SX₅GX₆RVX₇X₈X₉CRARQSIGTAIHWYQQK

X₁₀X₁₁X₁₂X₁₃PX₁₄LLIX₁₅YASESISGX₁₆PSRFSGSGSGTDFTLT

IX₁₇SX₁₈QX₁₉EDX₂₀AX₂₁YYCQQSX₂₂SWPYTFGX₂₃GTKLEIK
```

In some embodiments, the second antigen binding domain that binds a lymphocyte antigen comprises:
the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and a LCDR3 of SEQ ID NO: 260; or
the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

In some embodiments, the second antigen binding domain that binds a lymphocyte antigen comprises:
the VH of SEQ ID NO: 248 and the VL of SEQ ID NO: 249; or
the VH of SEQ ID NO: 248 and the VL of SEQ ID NO: 250; or
the VH of SEQ ID NO: 248 and the VL of SEQ ID NO: 251; or
the VH of SEQ ID NO: 248 and the VL of SEQ ID NO: 252; or
the VH of SEQ ID NO: 248 and the VL of SEQ ID NO: 253; or
the VH of SEQ ID NO: 248 and the VL of SEQ ID NO: 254.

In some embodiments, the second binding domain that binds a lymphocyte antigen comprises a VH which is at least 80% (e.g. at least 85%, at least 90%, at least 95% or at least 99%) identical to the VH of SEQ ID NO: 248 and a VL which is at least 80% (e.g. at least 85%, at least 90%, at least 95% or at least 99%) identical to the VL of SEQ ID NO: 251.

In some embodiments, the second binding domain that binds a lymphocyte antigen comprises a VH which is at least 80% (e.g. at least 85%, at least 90%, at least 95% or at least 99%) identical to the VH of SEQ ID NO: 248 and a VL of SEQ ID NO: 251.

In some embodiments, the second binding domain that binds a lymphocyte antigen comprises a VH of SEQ ID NO: 248 and a VL which is at least 80% (e.g. at least 85%, at least 90%, at least 95% or at least 99%) identical to the VL of SEQ ID NO: 251.

In a particular embodiment, the second binding domain that binds a lymphocyte antigen comprises a VH of SEQ ID NO: 248 and a VL of SEQ ID NO: 251.

In some embodiments, the second antigen binding domain that binds a lymphocyte antigen comprises the HCDR1 of SEQ ID NO: 116, the HCDR2 of SEQ ID NO: 117, the HCDR3 of SEQ ID NO: 118, the LCDR1 of SEQ ID NO: 119, the LCDR2 of SEQ ID NO: 120 and the LCDR3 of SEQ ID NO: 121; or the VH of SEQ ID NO: 122 and the VL of SEQ ID NO: 123.

In a particular embodiment, the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

In a particular embodiment, the first antigen binding domain that binds hK2 comprises the HCDR1, the HCDR2, the HCDR3, the LCDR1, the LCDR2 and the LCDR3 of SEQ ID NOs: 170, 171, 172, 173, 174 and 175, respectively and the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261

In a particular embodiment, the first antigen binding domain that binds hK2 comprises the HCDR1, the HCDR2, the HCDR3, the LCDR1, the LCDR2 and the LCDR3 of SEQ ID NOs: 194, 195, 172, 173, 174, and 175, respectively and the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

In a particular embodiment, the first antigen binding domain that binds hK2 comprises the HCDR1, the HCDR2, the HCDR3, the LCDR1, the LCDR2 and the LCDR3 of SEQ ID NOs: 170, 171, 172, 173, 174 and 175, respectively and the second antigen binding domain that binds a lymphocyte antigen comprises a VH of SEQ ID NO: 248 and a VL of SEQ ID NO: 251.

In a particular embodiment, the first antigen binding domain that binds hK2 comprises the HCDR1, the HCDR2, the HCDR3, the LCDR1, the LCDR2 and the LCDR3 of SEQ ID NOs: 194, 195, 172, 173, 174, and 175, respectively and the second antigen binding domain that binds a lymphocyte antigen comprises a VH of SEQ ID NO: 248 and a VL of SEQ ID NO: 251.

In a particular embodiment, the first antigen binding domain that binds hK2 comprises a VH of SEQ ID NO: 162 and a VL of SEQ ID NO: 163 and the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

In a particular embodiment, the first antigen binding domain that binds hK2 comprises a VH of SEQ ID NO: 162 and a VL of SEQ ID NO: 163 and the second antigen binding domain that binds a lymphocyte antigen comprises a VH of SEQ ID NO: 248 and a VL of SEQ ID NO: 251.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 255, 256, 275, 258, 259 and 261, respectively;

wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises a HCDR1, a HCDR2, a HCDR3, a LCDR1, a LCDR2 and a LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 170, 183, 184, 185, 186 and 187, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 176, 177, 178, 179, 180 and 181, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259, and 261, respectively; or
wherein the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 255, 256, 275, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises a HCDR1, a HCDR2, a HCDR3, a LCDR1, a LCDR2 and a LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 170, 183, 184, 185, 186 and 187, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 176, 177, 178, 179, 180 and 181, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259, and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:139 and the VL of SEQ ID NO:140, and the second binding domain that binds the lymphocyte antigen comprises the VH of SEQ ID NO: 248 and the VL of SEQ ID NO:251;

the first binding domain that binds hK2 comprises the VH of SEQ ID NO:139 and the VL of SEQ ID NO:140, and the second binding domain that binds the lymphocyte antigen comprises the VH of SEQ ID NO: 122 and the VL of SEQ ID NO:123;

wherein the first binding domain that binds hK2 comprises the VH of SEQ ID NO:137 and the VL of SEQ ID NO:138, and the second binding domain that binds the lymphocyte antigen comprises the VH of SEQ ID NO: 248 and the VL of SEQ ID NO:251;

the first binding domain that binds hK2 comprises the VH of SEQ ID NO:137 and the VL of SEQ ID NO:138, and the second binding domain that binds the lymphocyte antigen comprises the VH of SEQ ID NO: 122 and the VL of SEQ ID NO:123;

the first binding domain that binds hK2 comprises the VH of SEQ ID NO:168 and the VL of SEQ ID NO:169, and the second binding domain that binds the lymphocyte antigen comprises the VH of SEQ ID NO: 248 and the VL of SEQ ID NO:251;

the first binding domain that binds hK2 comprises the VH of SEQ ID NO:162 and the VL of SEQ ID NO:163, and the second binding domain that binds the lymphocyte antigen comprises the VH of SEQ ID NO: 248 and the VL of SEQ ID NO:251;

the first binding domain that binds hK2 comprises the VH of SEQ ID NO:166 and the VL of SEQ ID NO:444, and the second binding domain that binds the lymphocyte antigen comprises the VH of SEQ ID NO: 248 and the VL of SEQ ID NO:251;

the first binding domain that binds hK2 comprises the VH of SEQ ID NO:164 and the VL of SEQ ID NO:165, and the second binding domain that binds the lymphocyte antigen comprises the VH of SEQ ID NO: 248 and the VL of SEQ ID NO:251;

the first binding domain that binds hK2 comprises the VH of SEQ ID NO:168 and the VL of SEQ ID NO:169, and the second binding domain that binds the lymphocyte antigen comprises the VH of SEQ ID NO: 122 and the VL of SEQ ID NO:123;

the first binding domain that binds hK2 comprises the VH of SEQ ID NO:204 and the VL of SEQ ID NO:205, and the second binding domain that binds the lymphocyte antigen comprises the VH of SEQ ID NO: 122 and the VL of SEQ ID NO:123;

the first binding domain that binds hK2 comprises the VH of SEQ ID NO:204 and the VL of SEQ ID NO:205, and the second binding domain that binds the lymphocyte antigen comprises the VH of SEQ ID NO: 248 and the VL of SEQ ID NO:251; or the first binding domain that binds hK2 comprises the VH of SEQ ID NO:162 and the VL of SEQ ID NO:163, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:139 and the VL of SEQ ID NO:140, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:139 and the VL of SEQ ID NO:140, and the second binding domain that binds the lymphocyte antigen comprises the VH of SEQ ID NO: 122 and the VL of SEQ ID NO:123.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:137 and the VL of SEQ ID NO:138, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:137 and the VL of SEQ ID NO:138, and the second binding domain that binds the lymphocyte antigen comprises the VH of SEQ ID NO: 122 and the VL of SEQ ID NO:123.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:168 and the VL of SEQ ID NO:169, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:162 and the VL of SEQ ID NO:163, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:166 and the VL of SEQ ID NO:444, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:164 and the VL of SEQ ID NO:165, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:168 and the VL of SEQ ID NO:169, and the second binding domain that binds the lymphocyte antigen comprises the VH of SEQ ID NO: 122 and the VL of SEQ ID NO:123.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:204 and the VL of SEQ ID NO:205, and the second binding domain that binds the lymphocyte antigen comprises the VH of SEQ ID NO: 122 and the VL of SEQ ID NO:123.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:204 and the VL of SEQ ID NO:205, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein.

The disclosure also provides an isolated multispecific protein, comprising a first domain that binds hK2 and a second domain that binds a lymphocyte antigen, wherein the first binding domain that binds hK2 comprises the VH of SEQ ID NO:162 and the VL of SEQ ID NO:163, and the second binding domain that binds the lymphocyte antigen comprises the VH of SEQ ID NO: 248 and the VL of SEQ ID NO:251.

In some embodiments the isolated multispecific protein is an anti-hK2/anti-CD3 protein. In some embodiments, the first antigen binding domain that binds hK2 is conjugated to a first immunoglobulin (Ig) constant region or a fragment of the first Ig constant region and/or the second antigen binding domain that binds the lymphocyte antigen is conjugated to a second immunoglobulin (Ig) constant region or a fragment of the second Ig constant region.

In some embodiments, the fragment of the first Ig constant region and/or the fragment of the second Ig constant region comprises a Fc region.

In some embodiments, the fragment of the first Ig constant region and/or the fragment of the second Ig constant region comprises a CH2 domain.

In some embodiments, the fragment of the first Ig constant region and/or the fragment of the second Ig constant region comprises a CH3 domain.

In some embodiments, the fragment of the first Ig constant region and/or the fragment of the second Ig constant region comprises the CH2 domain and the CH3 domain.

In some embodiments, the fragment of the first Ig constant region and/or the fragment of the second Ig constant region comprises at least portion of a hinge, the CH2 domain and the CH3 domain.

In some embodiments, the fragment of the Ig constant region comprises the hinge, the CH2 domain and the CH3 domain.

In some embodiments, the multispecific protein further comprises a second linker (L2) between the first antigen binding domain that binds hK2 and the first Ig constant region or the fragment of the first Ig constant region and the second antigen binding domain that binds the lymphocyte antigen and the second Ig constant region or the fragment of the second Ig constant region.

In some embodiments, the L2 comprises the amino acid sequence of SEQ ID NOs: 7, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, or 108.

In some embodiments, the first Ig constant region or the fragment of the first Ig constant region and the second Ig constant region or the fragment of the second Ig constant region is an IgG1, an IgG2, and IgG3 or an IgG4 isotype.

In some embodiments, the first Ig constant region or the fragment of the first Ig constant region and the second Ig constant region or the fragment of the second Ig constant region is an IgG1 isotype.

In some embodiments, the first Ig constant region or the fragment of the first Ig constant region and the second Ig constant region or the fragment of the second Ig constant region is an IgG2 isotype.

In some embodiments, the first Ig constant region or the fragment of the first Ig constant region and the second Ig constant region or the fragment of the second Ig constant region is an IgG3 isotype.

In some embodiments, the first Ig constant region or the fragment of the first Ig constant region and the second Ig constant region or the fragment of the second Ig constant region is an IgG4 isotype.

In a particular embodiment, the first Ig constant region or the fragment of the first Ig constant region and the second Ig constant region or the fragment of the second Ig constant region is an IgG1 isotype.

The first Ig constant region or the fragment of the first Ig constant region and the second Ig constant region or the fragment of the second Ig constant region can further be engineered as described herein.

In some embodiments, the first Ig constant region or the fragment of the first Ig constant region and the second Ig constant region or the fragment of the second Ig constant region comprises at least one mutation that results in reduced binding of the multispecific protein to a FcγR.

In some embodiments, the at least one mutation that results in reduced binding of the multispecific protein to the FcγR is selected from the group consisting of F234A/L235A, L234A/L235A, L234A/L235A/D265S, V234A/G237A/P238S/H268A/V309L/A330S/P331S, F234A/L235A, S228P/F234A/L235A, N297A, V234A/G237A, K214T/E233P/L234V/L235A/G236-deleted/A327G/P331A/D365E/L358M, H268Q/V309L/A330S/P331S, S267E/L328F, L234F/L235E/D265A, L234A/L235A/G237A/P238S/H268A/A330S/P331S, S228P/F234A/L235A/G237A/P238S and S228P/F234A/L235A/G236-deleted/G237A/P238S, wherein residue numbering is according to the EU index. In a particular embodiment, the first Ig constant region or the fragment of the first Ig constant region and/or the second Ig constant region or the fragment of the second Ig constant region comprise the following mutations: L234A_L235A_D265S.

In some embodiments, the first Ig constant region or the fragment of the first Ig constant region and the second Ig constant region or the fragment of the second Ig constant region comprises at least one mutation that results in enhanced binding of the multispecific protein to a Fcγ receptor (FcγR).

In some embodiments, the at least one mutation that results in enhanced binding of the multispecific protein to the FcγR is selected from the group consisting of S239D/I332E. S298A/E333A/K334A, F243L/R292P/Y300L, F243L/R292P/Y300L/P396L, F243I/R292P/Y300L/V305I/P396L and G236A/S239D/I332E, wherein residue numbering is according to the EU index.

In some embodiments, the FcγR is FcγRI, FcγRIIA, FcγRIIB or FcγRIII, or any combination thereof.

In some embodiments, the first Ig constant region or the fragment of the first Ig constant region and the second Ig constant region or the fragment of the second Ig constant region comprises at least one mutation that modulates a half-life of the multispecific protein.

In some embodiments, the at least one mutation that modulates the half-life of the multispecific protein is selected from the group consisting of H435A, P257I/N434H, D376V/N434H, M252Y/S254T/T256E/H433K/N434F, T308P/N434A and H435R, wherein residue numbering is according to the EU index.

In some embodiments, the multispecific protein comprises at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region.

In some embodiments, the at least one mutation in a CH3 domain of the first Ig constant region or in a CH3 domain of the fragment of the first Ig constant region and/or at least one mutation in a CH3 domain of the second Ig constant region or in a CH3 domain of the fragment of the second Ig constant region is selected from the group consisting of T350V, L351Y, F405A, Y407V, T366Y, T366W, F405W, T394W, T394S, Y407T, Y407A, T366S/L368A/Y407V, L351Y/F405A/Y407V, T366I/K392M/T394W, F405A/Y407V, T366L/K392M/T394W, L351Y/Y407A, T366A/K409F, L351Y/Y407A, T366V/K409F, T366A/K409F, T350V/L35Y/F405A/Y407V and T350V/T366L/K392L/T394W, wherein residue numbering is according to the EU index. In a particular embodiment, the first Ig constant region or the fragment of the first Ig constant region comprises the following mutations T350V_T366L_K392L_T394W and/or the second Ig constant region or the fragment of the second Ig constant region comprises the following mutations T350V_L351Y_F405A_Y407V.

In some embodiments, the first Ig constant region or the fragment of the first Ig constant region and the second Ig constant region or the fragment of the second Ig constant region comprise the following mutations
L234A_L235A_D265S_T350V_L351Y_F405A_Y407V
in the first Ig constant region and
L235A_L235A_D265S_T350V_T366L_K392L_T394W
in the second Ig constant region; or
L235A_L235A_D265S_T350V_T366L_K392L_T394W
in the first Ig constant region and
L235A_L235A_D265S_T350V_L351Y_F405A_Y407V
in the second Ig constant region.

In some embodiments, the first Ig constant region or the fragment of the first Ig constant region and the second Ig constant region or the fragment of the second Ig constant region comprise the following mutations
L234A_L235A_D265S_T350V_L351Y_F405A_Y407V
in the first Ig constant region and
L234A_L235A_D265S_T350V_T366L_K392L_T394W
in the second Ig constant region; or
L234A_L235A_D265S_T350V_T366L_K392L_T394W
in the first Ig constant region and
L234A_L235A_D265S_T350V_L351Y_F405A_Y407V
in the second Ig constant region.

In some embodiments, the first Ig heavy chain constant region or the fragment of the first Ig heavy chain constant region comprises an amino acid sequence which is at least 80% (e.g. at least 85%, at least 90%, at least 95% or at least 99%) identical to SEQ ID NO: 378.

In a particular embodiment, the first Ig heavy chain constant region or the fragment of the first Ig heavy chain constant region comprises an amino acid sequence which is identical to SEQ ID NO: 378.

In some embodiments, the first Ig light chain constant region or the fragment of the first Ig light chain constant region comprises an amino acid sequence which is at least 80% (e.g. at least 85%, at least 90%, at least 95% or at least 99%) identical to SEQ ID NO: 309.

In a particular embodiment, the first Ig light chain constant region or the fragment of the first Ig light chain constant region comprises an amino acid sequence which is identical to SEQ ID NO: 309.

In some embodiments, the second Ig constant region or the fragment of the second Ig constant region comprises an amino acid sequence which is at least 80% (e.g. at least 85%, at least 90%, at least 95% or at least 99%) identical to SEQ ID NO: 109.

In a particular embodiment, the second Ig constant region or the fragment of the second Ig constant region comprises an amino acid sequence which is identical to SEQ ID NO: 109.

In a particular embodiment, the first Ig heavy chain constant region comprises an amino acid sequence which is identical to SEQ ID NO: 378, the first Ig light chain constant region comprises an amino acid sequence which is identical to SEQ ID NO: 309 and the second Ig constant region comprises an amino acid sequence which is identical to SEQ ID NO: 109.

In a particular embodiment, the isolated protein disclosed herein comprises a first antigen binding domain that binds hK2 and a first Ig heavy chain constant region or fragment of a first Ig heavy chain constant region comprising an amino acid sequence which is identical to SEQ ID NO: 378.

In a particular embodiment, the isolated protein disclosed herein comprises a first antigen binding domain that binds hK2 and a first Ig light chain constant region or fragment of a first Ig light chain constant region comprising an amino acid sequence which is identical to SEQ ID NO: 309.

In a particular embodiment, the isolated protein disclosed herein comprises a first antigen binding domain that binds hK2 and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309.

In a particular embodiment, the isolated protein disclosed herein comprises a second antigen binding domain that binds a lymphocyte antigen (e.g. CD3) and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2 and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309, and wherein the isolated protein further comprises a second antigen binding domain that binds a lymphocyte antigen (e.g. CD3) and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and a first Ig heavy chain constant region or fragment of a first Ig heavy chain constant region comprising an amino acid sequence which is identical to SEQ ID NO: 378.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and a first Ig light chain constant region or fragment of a first Ig light chain constant region comprising an amino acid sequence which is identical to SEQ ID NO: 309.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309.

In a particular embodiment, the isolated protein disclosed herein comprises a second antigen binding domain that binds a lymphocyte antigen (e.g. CD3), wherein the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261, and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises the HCDR1, the HCDR1, the HCDR3, the LCDR1, the LCDR2 and the LCDR3 of SEQ ID NOs: 170, 171, 172, 173, 174 and 175, respectively, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309, and wherein the isolated protein further comprises a second antigen binding domain that binds a lymphocyte antigen (e.g. CD3), wherein the second antigen binding domain that binds a lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261, and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and a first Ig heavy chain constant region or fragment of a first Ig heavy chain constant region comprising an amino acid sequence which is identical to SEQ ID NO: 378.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and a first Ig light chain constant region or fragment of a first Ig light chain constant region comprising an amino acid sequence which is identical to SEQ ID NO: 309.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309.

In a particular embodiment, the isolated protein disclosed herein comprises a second antigen binding domain that binds a lymphocyte antigen (e.g. CD3), wherein the second antigen binding domain that binds a lymphocyte antigen comprises the amino acid sequence of SEQ ID NO: 331, and a second Ig constant region or a fragment of a second Ig constant region comprising an amino acid sequence which is identical to SEQ ID NO: 109.

In a particular embodiment, the isolated protein disclosed herein comprises a first antigen binding domain that binds hK2, wherein the first antigen binding domain that binds hK2 comprises a VH of SEQ ID NO: 162 and a VL of SEQ ID NO: 163, and (i) a first Ig heavy chain constant region or fragment of a first Ig heavy chain constant region comprising an amino acid sequence which is identical to SEQ ID NO: 378; and (ii) a first Ig light chain constant region or fragment of a first Ig light chain constant region comprising an amino acid sequence which is identical to SEQ ID NO: 309, and wherein the isolated protein further comprises a second antigen binding domain that binds a lymphocyte antigen (e.g. CD3), wherein the second antigen binding domain that binds a lymphocyte antigen comprises the amino acid sequence of SEQ ID NO: 331, and a second Ig constant region or a fragment of a second Ig constant region comprising an amino acid sequence which is identical to SEQ ID NO: 109.

Generation of Multispecific Proteins that Comprise Antigen Binding Fragments that Bind hK2

The antigen binding fragments that bind hK2 of the disclosure may be engineered into multispecific antibodies which are also encompassed within the scope of the invention.

The antigen binding fragments that bind hK2 may be engineered into full length multispecific antibodies which are generated using Fab arm exchange, in which substitutions are introduced into two monospecific bivalent antibodies within the Ig constant region CH3 domain which promote Fab arm exchange in vitro. In the methods, two monospecific bivalent antibodies are engineered to have certain substitutions at the CH3 domain that promote heterodimer stability; the antibodies are incubated together under reducing conditions sufficient to allow the cysteines in the hinge region to undergo disulfide bond isomerization; thereby generating the bispecific antibody by Fab arm exchange. The incubation conditions may optimally be restored to non-reducing. Exemplary reducing agents that may be used are 2-mercaptoethylamine (2-MEA), dithiothreitol (DTT), dithioerythritol (DTE), glutathione, tris(2-carboxyethyl)phosphine (TCEP), L-cysteine and beta-mercaptoethanol, preferably a reducing agent selected from the group consisting of: 2-mercaptoethylamine, dithiothreitol and tris(2-carboxyethyl)phosphine. For example, incubation for at least 90 min at a temperature of at least 20° C. in the presence of at least 25 mM 2-MEA or in the presence of at least 0.5 mM dithiothreitol at a pH of from 5-8, for example at pH of 7.0 or at pH of 7.4 may be used.

CH3 mutations that may be used include technologies such as Knob-in-Hole mutations (Genentech), electrostatically-matched mutations (Chugai, Amgen, NovoNordisk Oncomed), the Strand Exchange Engineered Domain body (SEEDbody) (EMD Serono), Duobody® mutations (Genmab), and other asymmetric mutations (e.g. Zymeworks).

Knob-in-hole mutations are disclosed for example in WO1996/027011 and include mutations on the interface of CH3 region in which an amino acid with a small side chain (hole) is introduced into the first CH3 region and an amino acid with a large side chain (knob) is introduced into the second CH3 region, resulting in preferential interaction between the first CH3 region and the second CH3 region. Exemplary CH3 region mutations forming a knob and a hole are T366Y/F405A, T366W/F405W, F405W/Y407A, T394W/Y407T, T394S/Y407A, T366W/T394S, F405W/T394S and T366W/T366S_L368A_Y407V.

Heavy chain heterodimer formation may be promoted by using electrostatic interactions by substituting positively charged residues on the first CH3 region and negatively charged residues on the second CH3 region as described in US2010/0015133, US2009/0182127, US2010/028637 or US2011/0123532.

Other asymmetric mutations that can be used to promote heavy chain heterodimerization are L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/350V_T366L_K392L_T394W as described in US2012/0149876 or US2013/0195849 (Zymeworks).

SEEDbody mutations involve substituting select IgG residues with IgA residues to promote heavy chai heterodimerization as described in US20070287170.

Other exemplary mutations that may be used are R409D_K370E/D399K_E357K, S354C_T366W/Y349C_T366S_L368A_Y407V, Y349C_T366W/S354C_T366S_L368A_Y407V, T366K/L351D, L351K/Y349E, L351K/Y349D, L351K/L368E, L351Y_Y407A/T366A_K409F, L351Y_Y407A/T366V_K409F, K392D/D399K, K392D/E356K, K253E_D282K_K322D/D239K_E240K_K292D, K392D_K409D/D356K_D399K as described in WO2007/147901, WO 2011/143545, WO2013157954, WO2013096291 and US2018/0118849.

Duobody® mutations (Genmab) are disclosed for example in U.S. Pat. No. 9,150,663 and US2014/0303356 and include mutations F405L/K409R, wild-type/F405L_R409K, T350I_K370T_F405L/K409R, K370W/K409R, D399AFGHILMNRSTVWY/K409R, T366ADEFGHILMQVY/K409R, L368ADEGHNRSTVQ/K409AGRH, D399FHKRQ/K409AGRH, F405IKLSTVW/K409AGRH and Y407LWQ/K409AGRH.

Additional bispecific or multispecific structures into which the antigen binding domains that bind hK2 can be incorporated include Dual Variable Domain Immunoglobulins (DVD) (Int. Pat. Publ. No. WO2009/134776; DVDs are full length antibodies comprising the heavy chain having a structure VH1-linker-VH2-CH and the light chain having the structure VL1-linker-VL2-CL; linker being optional), structures that include various dimerization domains to connect the two antibody arms with different specificity, such as leucine zipper or collagen dimerization domains (Int. Pat. Publ. No. WO2012/022811, U.S. Pat. Nos. 5,932,448; 6,833,441), two or more domain antibodies (dAbs) conjugated together, diabodies, heavy chain only antibodies such as camelid antibodies and engineered camelid antibodies, Dual Targeting (DT)-Ig (GSK/Domantis), Two-in-one Antibody (Genentech), Cross-linked Mabs (Karmanos Cancer Center), mAb2 (F-Star) and CovX-body (CovX/Pfizer), IgG-like Bispecific (InnClone/Eli Lilly), Ts2Ab (MedImmune/AZ) and BsAb (Zymogenetics), HERCULES (Biogen Idec) and TvAb (Roche), ScFv/Fc Fusions (Academic Institution), SCORPION (Emergent BioSolutions/Trubion, Zymogenetics/BMS), Dual Affinity Retargeting Technology (Fc-DART) (MacroGenics) and Dual (ScFv)$_2$-Fab (National Research Center for Antibody Medicine—China), Dual-Action or Bis-Fab (Genentech), Dock-and-Lock (DNL) (ImmunoMedics), Bivalent Bispecific (Biotechnol) and Fab-Fv (UCB-Celltech). ScFv-, diabody-based, and domain antibodies, include but are not limited to, Bispecific T Cell Engager (BiTE) (Micromet), Tandem Diabody (Tandab) (Affimed), Dual Affinity Retargeting Technology (DART) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies.

The antigen binding domains that bind hK2 of the disclosure may also be engineered into multispecific proteins which comprise three polypeptide chains. In such designs, at least one antigen binding domain is in the form of a scFv. Exemplary designs include (in which "1" indicates the first antigen binding domain, "2" indicates the second antigen binding domain and "3" indicates the third antigen binding domain:

Design 1: Chain A) scFv1-CH2-CH3; Chain B) VL2-CL; Chain C) VH2-CH1-hinge-CH2-CH3

Design 2: Chain A) scFv1-hinge-CH2-CH3; Chain B) VL2-CL; Chain C) VH2-CH1-hinge-CH2-CH3

Design 3: Chain A) scFv1-CH1-hinge-CH2-CH3; Chain B) VL2-CL; Chain C) VH2-CH1-hinge-CH2-CH3

Design 4: Chain A) CH2-CH3-scFv1; Chain B) VL2-CL; Chain C) VH2-CH1-hinge-CH2-CH3

CH3 engineering may be incorporated to the Designs 1-4, such as mutations L351Y_F405A_Y407V/T394W, T366I_K392M_T394W/F405A_Y407V, T366L_K392M_T394W/F405A_Y407V, L351Y_Y407A/T366A_K409F, L351Y_Y407A/T366V_K409F, Y407A/T366A_K409F, or T350V_L351Y_F405A_Y407V/T350V_T366L_K392L_T394W as described in US2012/0149876 or US2013/0195849 (Zymeworks).

In a particular embodiment, the design is: Chain A) scFv-hinge-CH2-CH3; Chain B) VL2-CL; Chain C) VH2-CH1-hinge-CH2-CH3.

In some embodiment, the isolated multispecific protein comprises a first binding domain that binds hK2 and a second binding domain that binds a lymphocyte antigen (such as CD3), wherein the first antigen binding domain that binds hK2 comprises a HCDR1 of SEQ ID NOs: 63, 72, 141, 147, 170, 176, 188, 194, 196, 198, 200, 206, or 216, a HCDR2 of SEQ ID NOs: 64, 65, 73, 142, 148, 171, 177, 188, 189, 195, 197, 199, 201, 207, or 217, a HCDR3 of SEQ ID NOs: 66, 143, 172, 178, 184, 190, 208, or 218, a LCDR1 of SEQ ID NOs: 67, 68, 144, 173, 179, 182, 185 or 191 a LCDR2 of SEQ ID NOs: 69, 70, 145, 174, 180, 186, 192 or 470, and a LCDR3 of SEQ ID NOs: 71, 146, 175, 181, 187, 193, or 209.

In some embodiment the lymphocyte antigen is CD3. In some embodiment, the isolated multispecific protein comprises a first binding domain that binds hK2 and a second binding domain that binds a lymphocyte antigen (such as CD3), wherein the first antigen binding domain that binds hK2 comprises the HCDR1, the HCDR2, the HCDR3, the LCDR1, the LCDR2 and the LCDR3 of SEQ ID NOs: 141, 142, 143, 144, 145 and 146, respectively;
SEQ ID Nos: 170, 171, 172, 173, 174 and 175, respectively;
SEQ ID NO: 176, 177, 178, 179, 180 and 181, respectively;
SEQ ID NO: 170, 183, 184, 185, 186 and 187, respectively;
SEQ ID NO: 188, 189, 190, 191, 192 and 193, respectively;
SEQ ID NO: 206, 207, 208, 182, 470 and 209, respectively;
SEQ ID NOs: 147, 148, 143, 144, 145 and 146, respectively;
SEQ ID NO: 194, 195, 172, 173, 174 and 175, respectively;
SEQ ID NO: 196, 197, 178, 179, 190 and 181 respectively;
SEQ ID NO: 198, 199, 184, 185, 186 and 187, respectively;

SEQ ID NO: 200, 201, 190, 191, 192 and 193 respectively; or
SEQ ID NO: 216, 217, 218, 182, 470, and 209 respectively.

In some embodiment the lymphocyte antigen is CD3. In a particular embodiment, the isolated multispecific protein comprises a first binding domain that binds hK2 and a second binding domain that binds a lymphocyte antigen (e.g. CD3), wherein the first antigen binding domain that binds hK2 comprises the HCDR1, the HCDR2, the HCDR3, the LCDR1, the LCDR2 and the LCDR3 of SEQ ID NOs: 170, 171, 172, 173, 174 and 175, respectively or of SEQ ID NOs: 194, 195, 172, 173, 174, and 175, respectively.

In some embodiment, the isolated multispecific protein comprises a first binding domain that binds hK2 and a second binding domain that binds a lymphocyte antigen (such as CD3), wherein the first antigen binding domain that binds hK2 comprises
the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169; or
the VH of SEQ ID NO: 204 and the VL of SEQ ID NO: 205.

In some embodiment the lymphocyte antigen is CD3.

In some embodiment, the isolated multispecific protein comprises a first binding domain that binds hK2 and a second binding domain that binds a lymphocyte antigen (such as CD3), wherein the first antigen binding domain that binds hK2 comprises the VH of SEQ ID NO: 75 and the VL of SEQ ID NO: 74.

In some embodiment the lymphocyte antigen is CD3. In some embodiments, the isolated multispecific protein comprises a first binding domain that binds hK2 and a second binding domain that binds a lymphocyte antigen (e.g. CD3), wherein the first antigen binding domain that binds hK2 comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163.

In a particular embodiment, the isolated multispecific protein comprises a first binding domain that binds hK2 and a second binding domain that binds a lymphocyte antigen (e.g. CD3), wherein the first antigen binding domain that binds hK2 comprises a VH of SEQ ID NO: 162 and a VL which is at least 80% (e.g. at least 85%, at least 90%, at least 95% or at least 99%) identical to the VL of SEQ ID NO: 163.

In a particular embodiment, the isolated multispecific protein comprises a first binding domain that binds hK2 and a second binding domain that binds a lymphocyte antigen (e.g. CD3), wherein the first antigen binding domain that binds hK2 comprises a VH which is at least 80% (e.g. at least 85% a, at least 90%, at least 95% or at least 99%) identical to the VH of SEQ ID NO: 162 and a VL of SEQ ID NO: 163.

In a particular embodiment, the isolated multispecific protein comprises a first binding domain that binds hK2 and a second binding domain that binds a lymphocyte antigen (e.g. CD3), wherein the first antigen binding domain that binds hK2 comprises a VH which is at least 80% (e.g. at least 85%, at least 90%, at least 95% or at least 99%) identical to the VH of SEQ ID NO: 162 and a VL which is at least 80% (e.g. at least 85%, at least 90%, at least 95% or at least 99%) identical to the VL of SEQ ID NO: 163.

In a particular embodiment the isolated multispecific protein comprises a first binding domain that binds hK2 and a second binding domain that binds a lymphocyte antigen (e.g. CD3), wherein the first antigen binding domain that binds hK2 comprises a VH of SEQ ID NO: 162 and a VL of SEQ ID NO: 163.

In some embodiment, the isolated multispecific protein comprises a first binding domain that binds hK2 and a second binding domain that binds a lymphocyte antigen (such as CD3), wherein the first antigen binding domain that binds hK2 comprises the VH of SEQ ID NOs: 4, 5, 6, 137, 139, 159, or 161 and the VL of SEQ ID NOs: 1, 2, 3, 140, or 160 with the proviso that the antigen binding domain that binds hK2 does not comprise the VH of SEQ ID NO: 5 and the VL of SEQ ID NO: 2.

In some embodiment the lymphocyte antigen is CD3.

In some embodiment, the isolated multispecific protein comprises a first binding domain that binds hK2 and a second binding domain that binds a lymphocyte antigen (such as CD3), wherein the first antigen binding domain that binds hK2 comprises:
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 4 and the VL of SEQ ID NO: 140;
the VH of SEQ ID NO: 4 and the VL of SEQ ID NO: 160;
the VH of SEQ ID NO: 5 and the VL of SEQ ID NO: 1;
the VH of SEQ ID NO: 5 and the VL of SEQ ID NO: 3;
the VH of SEQ ID NO: 5 and the VL of SEQ ID NO: 140;
the VH of SEQ ID NO: 5 and the VL of SEQ ID NO: 160;
the VH of SEQ ID NO: 6 and the VL of SEQ ID NO: 1;
the VH of SEQ ID NO: 6 and the VL of SEQ ID NO: 2;
the VH of SEQ ID NO: 6 and the VL of SEQ ID NO: 3;
the VH of SEQ ID NO: 6 and the VL of SEQ ID NO: 140;
the VH of SEQ ID NO: 6 and the VL of SEQ ID NO: 160;
the VH of SEQ ID NO: 139 and the VL of SEQ ID NO: 1;
the VH of SEQ ID NO: 139 and the VL of SEQ ID NO: 2;
the VH of SEQ ID NO: 139 and the VL of SEQ ID NO: 3;
the VH of SEQ ID NO: 139 and the VL of SEQ ID NO: 140;
the VH of SEQ ID NO: 139 and the VL of SEQ ID NO: 160;
the VH of SEQ ID NO: 159 and the VL of SEQ ID NO: 1;
the VH of SEQ ID NO: 159 and the VL of SEQ ID NO: 2;
the VH of SEQ ID NO: 159 and the VL of SEQ ID NO: 3;
the VH of SEQ ID NO: 159 and the VL of SEQ ID NO: 140;
the VH of SEQ ID NO: 159 and the VL of SEQ ID NO: 160;
the VH of SEQ ID NO: 161 and the VL of SEQ ID NO: 1;
the VH of SEQ ID NO: 161 and the VL of SEQ ID NO: 2;
the VH of SEQ ID NO: 161 and the VL of SEQ ID NO: 3;
the VH of SEQ ID NO: 161 and the VL of SEQ ID NO: 140; or
the VH of SEQ ID NO: 161 and the VL of SEQ ID NO: 160.

In some embodiment the lymphocyte antigen is CD3.

In some embodiment, the isolated multispecific protein comprises a first binding domain that binds hK2 and a second binding domain that binds a lymphocyte antigen (such as CD3), wherein the first antigen binding domain that binds hK2 comprises the amino acid sequence of SEQ ID NOs: 8, 9, 10, 11, 12, 13, 14, 15, 16, 17, 18, 19, 20, 21, 22, 23, 133, 134, 135, 136, 308, 316, 318, 319, 320, 321, 322, 323, 324, 325, 404, 405, 406, 407, 408, or 409.

In some embodiment the lymphocyte antigen is CD3.

In some embodiments, the isolated multispecific protein comprises a first binding domain that binds hK2 and a second binding domain that binds a lymphocyte antigen (e.g. CD3), wherein the first antigen binding domain that binds hK2 comprises an amino acid sequence at least 80% (e.g. at least 85%, at least 90%, at least 95% or at least 99%) identical to the amino acid sequence of SEQ ID NO: 404 or 405.

In a particular embodiment, the isolated multispecific protein comprises a first binding domain that binds hK2 and a second binding domain that binds a lymphocyte antigen (e.g. CD3), wherein the first antigen binding domain that binds hK2 comprises an amino acid sequence of SEQ ID NO: 404 or 405.

In some embodiments, the isolated multispecific protein comprises a first binding domain that binds hK2 and a second binding domain that binds a lymphocyte antigen, wherein the second antigen binding domain that binds the lymphocyte antigen comprises a HCDR1 of SEQ ID NOs: 255 or 116, a HCDR2 of SEQ ID NOs: 256, or 117, a HCDR3 of SEQ ID NOs: 257, or 118, a LCDR1 of SEQ ID NOs: 258 or 119 a LCDR2 of SEQ ID NOs: 259, or 120, and a LCDR3 of SEQ ID NOs: 260, 261, or 121.

In some embodiment, the isolated multispecific protein comprises a first binding domain that binds hK2 and a second binding domain that binds a lymphocyte antigen, wherein the second antigen binding domain that binds the lymphocyte antigen comprises the VH of SEQ ID NO: 248 and the VL of SEQ ID NO: 157.

In some embodiments, the isolated multispecific protein comprises a first binding domain that binds hK2 and a second binding domain that binds a lymphocyte antigen, wherein the second antigen binding domain that binds the lymphocyte antigen comprises:
the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and a LCDR3 of SEQ ID NO: 260; or
the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

In some embodiments, the isolated multispecific protein comprises a first binding domain that binds hK2 and a second binding domain that binds a lymphocyte antigen, wherein the second antigen binding domain that binds the lymphocyte antigen comprises:
the VH of SEQ ID NO: 248 and the VL of SEQ ID NO: 249;
the VH of SEQ ID NO: 248 and the VL of SEQ ID NO: 250;
the VH of SEQ ID NO: 248 and the VL of SEQ ID NO: 251;
the VH of SEQ ID NO: 248 and the VL of SEQ ID NO: 252;
the VH of SEQ ID NO: 248 and the VL of SEQ ID NO: 253; or
the VH of SEQ ID NO: 248 and the VL of SEQ ID NO: 254.

In some embodiments, the isolated multispecific protein comprises a first binding domain that binds hK2 and a second binding domain that binds a lymphocyte antigen, wherein the second antigen binding domain that binds the lymphocyte antigen comprises a VH which is at least 80% (e.g. at least 85%, at least 90%, at least 95% or at least 99%) identical to the VH SEQ ID NO: 248 and a VL which is at least 80% (e.g. at least 85%, at least 90%, at least 95% or at least 99%) identical to the VL of SEQ ID NO: 251.

In a particular embodiment, the isolated multispecific protein comprises a first binding domain that binds hK2 and a second binding domain that binds a lymphocyte antigen, wherein the second antigen binding domain that binds the lymphocyte antigen comprises a VH of SEQ ID NO: 248 and a VL of SEQ ID NO: 251.

In some embodiment, the isolated multispecific protein comprises a first binding domain that binds hK2 and a second binding domain that binds a lymphocyte antigen, wherein the second antigen binding domain that binds the lymphocyte antigen comprises the HCDR1 of SEQ ID NO: 116, the HCDR2 of SEQ ID NO: 117, the HCDR3 of SEQ ID NO: 118, the LCDR1 of SEQ ID NO: 119, the LCDR2 of SEQ ID NO: 120 and the LCDR3 of SEQ ID NO: 121; or the VH of SEQ ID NO: 122 and the VL of SEQ ID NO: 123.

In a particular embodiment, the isolated multispecific protein comprises a first binding domain that binds hK2 and a second binding domain that binds a lymphocyte antigen, wherein the second antigen binding domain that binds the lymphocyte antigen comprises the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

In some embodiments, the second binding domain of the isolated multispecific protein, that binds the lymphocyte antigen, comprises the amino acid sequence of SEQ ID NOs: 326, 327, 328, 329, 330, 331, 332, 333, 334, 335, 336 or 337.

In a particular embodiment, the second binding domain of the isolated multispecific protein, that binds the lymphocyte antigen, comprises an amino acid sequence which is at least 80% (e.g. at least 85%, at least 90%, at least 95% or at least 99%) identical to the amino acid sequence of SEQ ID NO: 331.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 255, 256, 275, 258, 259 and 260, respectively;
the first binding domain that binds hK2 comprises a scFv of SEQ ID NO: 136, and the second binding domain that binds the lymphocyte antigen comprises the VH of SEQ ID NO: 248 and the VL of SEQ ID NO: 251; and/or
the isolated multispecific protein comprises a HC1 of SEQ ID NO: 351, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1 the LCDR2 and the LCDR3 of SEQ ID NOs: 116, 117, 118, 119, 120 and 121, respectively;
the first binding domain that binds hK2 comprises a scFv of SEQ ID NO: 136, and the second binding domain that binds the lymphocyte antigen comprises the VH of SEQ ID NO: 122 and the VL of SEQ ID NO: 123; and/or
the isolated multispecific protein comprises a HC1 of SEQ ID NO: 351, a HC2 of SEQ ID NO: 359 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 260, respectively;
the first binding domain that binds hK2 comprises a scFv of SEQ ID NO: 134, and the second binding domain that binds the lymphocyte antigen comprises the VH of SEQ ID NO: 248 and the VL of SEQ ID NO: 251; and/or
the isolated multispecific protein comprises a HC1 of SEQ ID NO: 352, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
the first binding domain that binds hK2 comprises a scFv of SEQ ID NO: 134, and the second binding domain that binds the lymphocyte antigen comprises the VH of SEQ ID NO: 122 and the VL of SEQ ID NO: 123; and/or
the isolated multispecific protein comprises a HC1 of SEQ ID NO: 352, a HC2 of SEQ ID NO: 259 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 260, respectively;
the first binding domain that binds hK2 comprises a scFv of SEQ ID NO: 325, and the second binding domain that binds the lymphocyte antigen comprises the VH of SEQ ID NO: 248 and the VL of SEQ ID NO: 251; and/or
the isolated multispecific protein comprises a HC1 of SEQ ID NO: 353, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 260, respectively;
the first binding domain that binds hK2 comprises a VH of SEQ ID NO: 162 and the VL of SEQ ID NO: 163, and the second binding domain that binds the lymphocyte antigen comprises a scFv of SEQ ID NO: 331; and/or
the isolated multispecific protein comprises a HC1 of SEQ ID NO: 354, a LC1 of SEQ ID NO: 221 and a HC2 of SEQ ID NO: 360.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 170, 183, 184, 185, 186 and 187, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 260, respectively;
the first binding domain that binds hK2 comprises a VH of SEQ ID NO: 166 and the VL of SEQ ID NO: 444, and the second binding domain that binds the lymphocyte antigen comprises a scFv of SEQ ID NO: 331; and/or
the isolated multispecific protein comprises a HC1 of SEQ ID NO: 355 a LC1 of SEQ ID NO: 445 and a HC2 of SEQ ID NO: 360.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 176, 177, 178, 179, 180 and 181, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 260, respectively;
the first binding domain that binds hK2 comprises a VH of SEQ ID NO: 164 and the VL of SEQ ID NO: 165, and the second binding domain that binds the lymphocyte antigen comprises a scFv of SEQ ID NO: 331; and/or
the isolated multispecific protein comprises a HC1 of SEQ ID NO: 356, a LC1 of SEQ ID NO: 222 and a HC2 of SEQ ID NO: 360.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
the first binding domain that binds hK2 comprises a scFv of SEQ ID NO: 325, and the second binding domain that binds the lymphocyte antigen comprises a VH of SEQ ID NO: 122 and a VL of SEQ ID NO: 123; and/or
the isolated multispecific protein comprises a HC1 of SEQ ID NO: 353, a HC2 of SEQ ID NO: 359 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
the first binding domain that binds hK2 comprises a scFv of SEQ ID NO: 316, and the second binding domain that binds the lymphocyte antigen comprises a VH of SEQ ID NO: 122 and a VL of SEQ ID NO: 123; and/or
the isolated multispecific protein comprises a HC1 of SEQ ID NO: 357, a HC2 of SEQ ID NO: 359 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 260, respectively;
the first binding domain that binds hK2 comprises a scFv of SEQ ID NO: 316, and the second binding domain that binds the lymphocyte antigen comprises a VH of SEQ ID NO: 248 and a VL of SEQ ID NO: 151; and/or
the isolated multispecific protein comprises a HC1 of SEQ ID NO: 357, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 260, respectively;
the first binding domain that binds hK2 comprises a VH of SEQ ID NO: 162 and the VL of SEQ ID NO: 163, and the second binding domain that binds the lymphocyte antigen comprises a scFv of SEQ ID NO: 331; and/or
the isolated multispecific protein comprises a HC1 of SEQ ID NO: 361, a LC1 of SEQ ID NO: 221 and a HC2 of SEQ ID NO: 362.

In some embodiments the isolated multispecific protein is an anti-hK2/anti-CD3 protein.

The disclosure also provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 255, 256, 275, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises a HCDR1, a HCDR2, a HCDR3, a LCDR1, a LCDR2 and a LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 170, 183, 184, 185, 186 and 187, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 176, 177, 178, 179, 180 and 181, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively;
wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively;
wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259, and 261, respectively; or
wherein the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 255, 256, 275, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises a HCDR1, a HCDR2, a HCDR3, a LCDR1, a LCDR2 and a LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 170, 183, 184, 185, 186 and 187, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 176, 177, 178, 179, 180 and 181, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259, and 261, respectively.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.

The disclosure also provides an isolated multispecific protein, comprising a first domain that binds hK2 and a second domain that binds CD3, wherein
the first binding domain that binds hK2 comprises a scFv of SEQ ID NO: 136, and the second binding domain that binds the lymphocyte antigen comprises the VH of SEQ ID NO: 248 and the VL of SEQ ID NO: 251;
the first binding domain that binds hK2 comprises a scFv of SEQ ID NO: 136, and the second binding domain that binds the lymphocyte antigen comprises the VH of SEQ ID NO: 122 and the VL of SEQ ID NO: 123;
the first binding domain that binds hK2 comprises a scFv of SEQ ID NO: 134, and the second binding domain that binds the lymphocyte antigen comprises the VH of SEQ ID NO: 248 and the VL of SEQ ID NO: 251;
the first binding domain that binds hK2 comprises a scFv of SEQ ID NO: 134, and the second binding domain that binds the lymphocyte antigen comprises the VH of SEQ ID NO: 122 and the VL of SEQ ID NO: 123;
the first binding domain that binds hK2 comprises a scFv of SEQ ID NO: 325, and the second binding domain that binds the lymphocyte antigen comprises the VH of SEQ ID NO: 248 and the VL of SEQ ID NO: 251;
the first binding domain that binds hK2 comprises a VH of SEQ ID NO: 162 and a VL of SEQ ID NO: 163, and the second binding domain that binds the lymphocyte antigen comprises a scFv of SEQ ID NO: 331;
the first binding domain that binds hK2 comprises a VH of SEQ ID NO: 166 and the VL of SEQ ID NO: 444, and the second binding domain that binds the lymphocyte antigen comprises a scFv of SEQ ID NO: 331;
the first binding domain that binds hK2 comprises a VH of SEQ ID NO: 164 and the VL of SEQ ID NO: 165, and the second binding domain that binds the lymphocyte antigen comprises a scFv of SEQ ID NO: 331;
the first binding domain that binds hK2 comprises a scFv of SEQ ID NO: 325, and the second binding domain that binds the lymphocyte antigen comprises a VH of SEQ ID NO: 122 and a VL of SEQ ID NO: 123;
the first binding domain that binds hK2 comprises a scFv of SEQ ID NO: 316, and the second binding domain that binds the lymphocyte antigen comprises a VH of SEQ ID NO: 122 and a VL of SEQ ID NO: 123;
the first binding domain that binds hK2 comprises a scFv of SEQ ID NO: 316, and the second binding domain that binds the lymphocyte antigen comprises a VH of SEQ ID NO: 248 and a VL of SEQ ID NO: 151; or
the first binding domain that binds hK2 comprises a VH of SEQ ID NO: 162 and the VL of SEQ ID NO: 163, and the second binding domain that binds the lymphocyte antigen comprises a scFv of SEQ ID NO: 331.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 136, and the second binding domain that binds the lymphocyte antigen comprises the VH of SEQ ID NO: 248 and the VL of SEQ ID NO: 251.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 136, and the second binding domain that binds the lymphocyte antigen comprises the VH of SEQ ID NO: 122 and the VL of SEQ ID NO: 123.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 134, and the second binding domain that binds the lymphocyte antigen comprises the VH of SEQ ID NO: 248 and the VL of SEQ ID NO: 251.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 134, and the second binding domain that binds the lymphocyte antigen comprises the VH of SEQ ID NO: 122 and the VL of SEQ ID NO: 123.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 325, and the second binding domain that binds the lymphocyte antigen comprises the VH of SEQ ID NO: 248 and the VL of SEQ ID NO: 251.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a VH of SEQ ID NO: 162 and a VL of SEQ ID NO: 163, and the second binding domain that binds the lymphocyte antigen comprises a scFv of SEQ ID NO: 331.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a VH of SEQ ID NO: 166 and the VL of SEQ ID NO: 444, and the second binding domain that binds the lymphocyte antigen comprises a scFv of SEQ ID NO: 331.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a VH of SEQ ID NO: 164 and the VL of SEQ ID NO: 165, and the second binding domain that binds the lymphocyte antigen comprises a scFv of SEQ ID NO: 331.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 325, and the second binding domain that binds the lymphocyte antigen comprises a VH of SEQ ID NO: 122 and a VL of SEQ ID NO: 123.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 316, and the second binding domain that binds the lymphocyte antigen comprises a VH of SEQ ID NO: 122 and a VL of SEQ ID NO: 123.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a scFv of SEQ ID NO: 316, and the second binding domain that binds the lymphocyte antigen comprises a VH of SEQ ID NO: 248 and a VL of SEQ ID NO: 151.

In some embodiments the isolated multispecific protein is an anti-hK2/anti-CD3 protein.

The disclosure also provides an isolated multispecific protein, comprising a first domain that binds hK2 and a second domain that binds CD3, wherein the first binding domain that binds hK2 comprises a VH of SEQ ID NO: 162 and the VL of SEQ ID NO: 163, and the second binding domain that binds the lymphocyte antigen comprises a scFv of SEQ ID NO: 331.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated protein comprises:
a HC1 of SEQ ID NO: 351, a HC2 of SEQ ID NO: 358 and a LC2 of SEQ ID NO: 267;
a HC1 of SEQ ID NO: 351, a HC2 of SEQ ID NO: 359 and a LC2 of SEQ ID NO: 272;
a HC1 of SEQ ID NO: 352, a HC2 of SEQ ID NO: 358 and a LC2 of SEQ ID NO: 267;
a HC1 of SEQ ID NO: 352, a HC2 of SEQ ID NO: 359 and a LC2 of SEQ ID NO: 272;
a HC1 of SEQ ID NO: 353, a HC2 of SEQ ID NO: 358 and a LC2 of SEQ ID NO: 267;
a HC1 of SEQ ID NO: 354, a LC1 of SEQ ID NO: 221 and a HC2 of SEQ ID NO: 360;
a HC1 of SEQ ID NO: 355 a LC1 of SEQ ID NO: 223 and a HC2 of SEQ ID NO: 360;
a HC1 of SEQ ID NO: 356, a LC1 of SEQ ID NO: 222 and a HC2 of SEQ ID NO: 360;
a HC1 of SEQ ID NO: 353, a HC2 of SEQ ID NO: 359 and a LC2 of SEQ ID NO: 272;
a HC1 of SEQ ID NO: 357, a HC2 of SEQ ID NO: 359 and a LC2 of SEQ ID NO: 272;
a HC1 of SEQ ID NO: 357, a HC2 of SEQ ID NO: 358 and a LC2 of SEQ ID NO: 267; or
a HC1 of SEQ ID NO: 361, a LC1 of SEQ ID NO: 221 and a HC2 of SEQ ID NO: 362.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated protein comprises a HC1 of SEQ ID NO: 351, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 351, a HC2 of SEQ ID NO: 359 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein, the isolated multispecific protein comprises a HC1 of SEQ ID NO: 352, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 352, a HC2 of SEQ ID NO: 359 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 353, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 354, a LC1 of SEQ ID NO: 221 and a HC2 of SEQ ID NO: 360.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 355 a LC1 of SEQ ID NO: 223 and a HC2 of SEQ ID NO: 360.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 356, a LC1 of SEQ ID NO: 222 and a HC2 of SEQ ID NO: 360.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 353, a HC2 of SEQ ID NO: 359 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 357, a HC2 of SEQ ID NO: 359 and a LC2 of SEQ ID NO: 272.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 357, a HC2 of SEQ ID NO: 358 and a LC2 of SEQ ID NO: 267.

In some embodiments the isolated multispecific protein is an anti-hK2/anti-CD3 protein.

The disclosure also provides an isolated multispecific protein, comprising a first domain that binds hK2 and a second domain that binds CD3, wherein the isolated multispecific protein comprises a HC1 of SEQ ID NO: 361, a LC1 of SEQ ID NO: 221 and a HC2 of SEQ ID NO: 362.

In some embodiments the isolated multispecific protein is an anti-hK2/anti-CD3 protein.

In a particular embodiment, the disclosure provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds CD3 comprises the HCDR1, the HCDR2, the HCDR3, the LCDR1, the LCDR2 and the LCDR3 of SEQ ID NOs: 255, 256, 257, 258, 259 and 261, respectively;
the first binding domain that binds hK2 comprises a VH of SEQ ID NO: 162 and the VL of SEQ ID NO: 163, and the second binding domain that binds CD3 comprises a scFv of SEQ ID NO: 331; and/or
the isolated multispecific protein comprises a HC1 of SEQ ID NO: 354, a LC1 of SEQ ID NO: 221 and a HC2 of SEQ ID NO: 360.

In some embodiments, the isolated multispecific protein comprises a lysine (e.g. K477) at the C-terminus of both of the Fc domains (i.e. the HC1 and HC2 domains). An additional lysine may enhance expression of the construct. Accordingly, in a particular embodiment, the isolated multispecific protein comprises a HC1 of SEQ ID NO: 361, a LC1 of SEQ ID NO: 221 and a HC2 of SEQ ID NO: 362.

In some embodiments, the disclosure provides an isolated multispecific protein, comprising a first domain that binds hK2 and a second domain that binds CD3, wherein
the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds CD3 comprises the HCDR1, the HCDR2, the HCDR3, the LCDR1, the LCDR2 and the LCDR3 of SEQ ID NOs: 255, 256, 257, 258, 259 and 261, respectively;
the first binding domain that binds hK2 comprises a VH of SEQ ID NO: 162 and the VL of SEQ ID NO: 163, and the second binding domain that binds CD3 comprises a scFv of SEQ ID NO: 331; and/or
the isolated multispecific protein comprises a HC1 of SEQ ID NO: 361, a LC1 of SEQ ID NO: 221 and a HC2 of SEQ ID NO: 362.

In some embodiments, the disclosure provides an isolated multispecific protein, comprising a first domain that binds hK2 and a second domain that binds CD3, wherein the first binding domain that binds hK2 comprises a VH which is at least 80% identical to the VH of SEQ ID NO: 162 and a VL which is at least 80% identical to the VL of SEQ ID NO: 163, and the second binding domain that binds CD3 comprises a scFv which is at least 80% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 85% identical to the VH of SEQ ID NO: 162 and a VL which is at least 85% identical to the VL of SEQ ID NO: 163, and the second binding domain that binds CD3 comprises a scFv which is at least 85% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 90% identical to the VH of SEQ ID NO: 162 and a VL which is at least 90% identical to the VL of SEQ ID NO: 163, and the second binding domain that binds CD3 comprises a scFv which is at least 90% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 95% identical to the VH of SEQ ID NO: 162 and a VL which is at least 95% identical to the VL of SEQ ID NO: 163, and the second binding domain that binds CD3 comprises a scFv which is at least 95% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 99% identical to the VH of SEQ ID NO: 162 and a VL which is at least 99% identical to the VL of SEQ ID NO: 163, and the second binding domain that binds CD3 comprises a scFv which is at least 99% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a the VH of SEQ ID NO: 162 and a VL which is at least 95% identical to the VL of SEQ ID NO: 163, and the second binding domain that binds CD3 comprises a scFv which is at least 95% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a the VH of SEQ ID NO: 162 and a VL which is at least 99% identical to the VL of SEQ ID NO: 163, and the second binding domain that binds CD3 comprises a scFv which is at least 99% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 95% identical to the VH of SEQ ID NO: 162 and a VL of SEQ ID NO: 163, and the second binding domain that binds CD3 comprises a scFv which is at least 95% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 99% identical to the VH of SEQ ID NO: 162 and a VL of SEQ ID NO: 163, and the second binding domain that binds CD3 comprises a scFv which is at least 99% identical to the scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 95% identical to the VH of SEQ ID NO: 162 and a VL which is at least 95% identical to the VL of SEQ ID NO: 163, and the second binding domain that binds CD3 comprises a scFv of SEQ ID NO: 331.

In some embodiments, the disclosure provides an isolated multispecific protein, comprising a first domain that binds hK2 and a second domain that binds CD3, wherein the first binding domain that binds hK2 comprises a VH which is at least 99% identical to the VH of SEQ ID NO: 162 and a VL which is at least 99% identical to the VL of SEQ ID NO: 163, and the second binding domain that binds CD3 comprises a scFv of SEQ ID NO: 331.

In a particular embodiment, the disclosure provides an isolated multispecific protein, comprising a first domain that binds hK2 and a second domain that binds CD3, wherein the first binding domain that binds hK2 comprises a VH of SEQ ID NO: 162 and a VL of SEQ ID NO: 163, and the second binding domain that binds CD3 comprises a scFv of SEQ ID NO: 331.

In some embodiments, the disclosure provides an isolated multispecific protein, comprising a first domain that binds hK2 and a second domain that binds CD3, wherein the isolated multispecific protein comprises a HC1 which is at least 80% identical to the HC1 of SEQ ID NO: 354, a LC1 which is at least 80% identical to the LC1 of SEQ ID NO: 221 and a HC2 which is at least 80% identical to the HC2 of SEQ ID NO: 360.

In some embodiments, the disclosure provides an isolated multispecific protein, comprising a first domain that binds hK2 and a second domain that binds CD3, wherein the isolated multispecific protein comprises a HC1 which is at least 85% identical to the HC1 of SEQ ID NO: 354, a LC1 which is at least 85% identical to the LC1 of SEQ ID NO: 221 and a HC2 which is at least 85% identical to the HC2 of SEQ ID NO: 360.

In some embodiments, the disclosure provides an isolated multispecific protein, comprising a first domain that binds hK2 and a second domain that binds CD3, wherein the isolated multispecific protein comprises a HC1 which is at least 90% identical to the HC1 of SEQ ID NO: 354, a LC1 which is at least 90% identical to the LC1 of SEQ ID NO: 221 and a HC2 which is at least 90% identical to the HC2 of SEQ ID NO: 360.

In some embodiments, the disclosure provides an isolated multispecific protein, comprising a first domain that binds hK2 and a second domain that binds CD3, wherein the isolated multispecific protein comprises a HC1 which is at least 95% identical to the HC1 of SEQ ID NO: 354, a LC1 which is at least 95% identical to the LC1 of SEQ ID NO: 221 and a HC2 which is at least 95% identical to the HC2 of SEQ ID NO: 360.

In some embodiments, the disclosure provides an isolated multispecific protein, comprising a first domain that binds hK2 and a second domain that binds CD3, wherein the isolated multispecific protein comprises a HC1 which is at least 99% identical to the HC1 of SEQ ID NO: 354, a LC1 which is at least 99% identical to the LC1 of SEQ ID NO: 221 and a HC2 which is at least 99% identical to the HC2 of SEQ ID NO: 360.

In some embodiments, the isolated multispecific protein comprises a lysine (e.g. K477) at the C-terminus of both of the Fc domains (i.e. the HC1 and HC2 domains). Accordingly, in some embodiments, the isolated multispecific protein comprises a HC1 which comprises a C-terminal lysine and is at least 80% (e.g. at least 85%, at least 90%, at least 95% or at least 99%) identical to the HC1 of SEQ ID NO: 361 and a HC2 which comprises a C-terminal lysine and is at least 80% (e.g. at least 85%, at least 90%, at least 95% or at least 99%) identical to the HC2 of SEQ ID NO: 362.

In some embodiments, the disclosure provides an isolated multispecific protein, comprising a first domain that binds hK2 and a second domain that binds CD3, wherein the antigen binding domain binding to hK2 binds to hK2 at three or more residues within epitopes having sequences of SEQ ID NO: 111 and SEQ ID NO: 112. In some embodiments, the disclosure provides an isolated multispecific protein, comprising a first domain that binds hK2 and a second domain that binds CD3, wherein the antigen binding domain binding to CD3 binds to CD3 at three or more residues within epitopes having sequences of SEQ ID NO: 341, SEQ ID NO: 448 and SEQ ID NO: 449.

In a particular embodiment, the disclosure provides an isolated multispecific protein, comprising a first domain that binds hK2 and a second domain that binds CD3, wherein the antigen binding domain binding to hK2 binds to hK2 within epitopes having sequences of SEQ ID NO: 111 and SEQ ID NO: 112 and wherein the antigen binding domain binding to CD3 binds to CD3 within epitopes having sequences of SEQ ID NO: 341, SEQ ID NO: 448 and SEQ ID NO: 449.

Isotypes, Allotypes and Fc Engineering

The Ig constant region or the fragment of the Ig constant region, such as the Fc region present in the proteins of the disclosure may be of any allotype or isotype.

In some embodiments, the Ig constant region or the fragment of the Ig constant region is an IgG1 isotype.

In some embodiments, the Ig constant region or the fragment of the Ig constant region is an IgG2 isotype.

In some embodiments, the Ig constant region or the fragment of the Ig constant region is an IgG3 isotype.

In some embodiments, the Ig constant region or the fragment of the Ig constant region is an IgG4 isotype.

The Ig constant region or the fragment of the Ig constant region may be of any allotype. It is expected that allotype has no influence on properties of the Ig constant region, such as binding or Fc-mediated effector functions. Immunogenicity of therapeutic proteins comprising Ig constant regions of fragments thereof is associated with increased risk of infusion reactions and decreased duration of therapeutic response (Baert et al., (2003) *N Engl J Med* 348:602-08). The extent to which therapeutic proteins comprising Ig constant regions of fragments thereof induce an immune response in the host may be determined in part by the allotype of the Ig constant region (Stickler et al., (2011) *Genes and Immunity* 12:213-21). Ig constant region allotype is related to amino acid sequence variations at specific locations in the constant region sequences of the antibody. Table 2 shows select IgG1, IgG2 and IgG4 allotypes.

TABLE 2

| | Amino acid residue at position of diversity (residue numbering: EU Index) | | | | | | | |
|---|---|---|---|---|---|---|---|---|
| | IgG2 | | IgG4 | | IgG1 | | | |
| Allotype | 189 | 282 | 309 | 422 | 214 | 356 | 358 | 431 |
| G2m(n) | T | M | | | | | | |
| G2m(n-) | P | V | | | | | | |
| G2m(n)/(n-) | T | V | | | | | | |
| nG4m(a) | | | L | R | | | | |
| G1m(17) | | | | | K | E | M | A |
| G1m(17.1) | | | | | K | D | L | A |
| G1m(3) | | | | | R | E | M | A |

In a particular embodiment, the Ig constant region allotype is huIgG1_G1m(17).

C-terminal lysine (CTL) may be removed from the Ig constant region by endogenous circulating carboxypeptidases in the blood stream (Cai et al., (2011) *Biotechnol Bioeng* 108:404-412). During manufacturing, CTL removal may be controlled to less than the maximum level by control of concentration of extracellular $Zn^{2+}$, EDTA or EDTA-$Fe^{3+}$ as described in U.S. Patent Publ. No. US20140273092. CTL content of proteins may be measured using known methods.

In some embodiments, the antigen binding fragment that binds hK2 conjugated to the Ig constant region has a C-terminal lysine content from about 10% to about 90%. In some embodiments, the C-terminal lysine content is from about 20% to about 80%. In some embodiments, the C-terminal lysine content is from about 40% to about 70%. In some embodiments, the C-terminal lysine content is from about 55% to about 70%. In some embodiments, the C-terminal lysine content is about 60%.

Fc region mutations may be made to the antigen binding domains that bind hK2 conjugated to the Ig constant region or to the fragment of the Ig constant region to modulate their effector functions such as ADCC, ADCP and/or ADCP and/or pharmacokinetic properties. This may be achieved by introducing mutation(s) into the Fc that modulate binding of the mutated Fc to activating FcγRs (FcγRI, FcγRIIa, FcγRIII), inhibitory FcγRIIb and/or to FcRn.

In some embodiments, the antigen binding domain that binds hK2 conjugated to the Ig constant region or the fragment of the Ig constant region comprises at least one mutation in the Ig constant region or in the fragment of the Ig constant region.

In some embodiments, the at least one mutation is in the Fc region.

In some embodiments, the antigen binding domain that binds hK2 conjugated to the Ig constant region or to the fragment of the Ig constant region comprises at least one, two, three, four, five, six, seven, eight, nine, ten, eleven, twelve, thirteen, fourteen or fifteen mutations in the Fc region.

In some embodiments, the antigen binding domain that binds hK2s conjugated to the Ig constant region or to the fragment of the Ig constant region comprises at least one mutation in the Fc region that modulates binding of the antibody to FcRn.

Fc positions that may be mutated to modulate half-life (e.g. binding to FcRn) include positions 250, 252, 253, 254, 256, 257, 307, 376, 380, 428.434 and 435. Exemplary mutations that may be made singularly or in combination are mutations T250Q, M252Y, I253A, S254T, T256E, P257I, T307A, D376V, E380A, M428L, H433K, N434S, N434A, N434H, N434F, H435A and H435R. Exemplary singular or combination mutations that may be made to increase the half-life are mutations M428L/N434S, M252Y/S254T/T256E, T250Q/M428L, N434A and T307A/E380A/N434A. Exemplary singular or combination mutations that may be made to reduce the half-life are mutations H435A, P257I/N434H, D376V/N434H, M252Y/S254T/T256E/H433K/N434F, T308P/N434A and H435R.

In some embodiments, the antigen binding domain that binds hK2 conjugated to the Ig constant region or to the fragment of the Ig constant region comprises M252Y/S254T/T256E mutation.

In some embodiments, the antigen binding domain that binds hK2 conjugated to the Ig constant region or to the fragment of the Ig constant region comprises at least one mutation in the Fc region that reduces binding of the protein to an activating Fcγ receptor (FcγR) and/or reduces Fc effector functions such as C1q binding, complement dependent cytotoxicity (CDC), antibody-dependent cell-mediated cytotoxicity (ADCC) or phagocytosis (ADCP).

Fc positions that may be mutated to reduce binding of the protein to the activating FcγR and subsequently to reduce effector function include positions 214, 233, 234, 235, 236, 237, 238, 265, 267, 268, 270, 295, 297, 309, 327, 328, 329, 330, 331 and 365. Exemplary mutations that may be made singularly or in combination are mutations K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, A330S and P331S in IgG1, IgG2, IgG3 or IgG4. Exemplary combination mutations that result in proteins with reduced ADCC are mutations L234A/L235A on IgG1, L234A/L235A/D265S on IgG1, V234A/G237A/P238S/H268A/V309L/A330S/P331S on IgG2, F234A/L235A on IgG4, S228P/F234A/L235A on IgG4, N297A on all Ig isotypes, V234A/G237A on IgG2, K214T/E233P/L234V/L235A/G236-deleted/A327G/P331A/D365E/L358M on IgG1, H268Q/V309L/A330S/P331S on IgG2, S267E/L328F on IgG1, L234F/L235E/D265A on IgG1, L234A/L235A/G237A/P238S/H268A/A330S/P331S on IgG1, S228P/F234A/L235A/G237A/P238S on IgG4, and S228P/F234A/L235A/G236-deleted/G237A/P238S on IgG4. Hybrid IgG2/4 Fc domains may also be used, such as Fc with residues 117-260 from IgG2 and residues 261-447 from IgG4.

Exemplary mutation that result in proteins with reduced CDC is a K322A mutation.

Well-known S228P mutation may be made in IgG4 to enhance IgG4 stability.

In some embodiments, the antigen binding domain that binds hK2 conjugated to the Ig constant region or to the fragment of the Ig constant region comprises at least one mutation selected from the group consisting of K214T, E233P, L234V, L234A, deletion of G236, V234A, F234A, L235A, G237A, P238A, P238S, D265A, S267E, H268A, H268Q, Q268A, N297A, A327Q, P329A, D270A, Q295A, V309L, A327S, L328F, K322, A330S and P331S.

In some embodiments, the antigen binding domain that binds hK2 conjugated to the Ig constant region or to the fragment of the Ig constant region comprises L234A/L235A/D265S mutation. In a particular embodiment, the antigen binding domain that binds hK2 is conjugated to an IgG1 constant region or to the fragment of an IgG1 constant region comprising L234A_L235A_D265S mutations.

In some embodiments, the antigen binding domain that binds hK2 conjugated to the Ig constant region or to the fragment of the Ig constant region comprises L234A/L235A mutation.

In some embodiments, the antigen binding domain that binds hK2 conjugated to the Ig constant region or to the fragment of the Ig constant region comprises at least one mutation in the Fc region that enhances binding of the protein to an Fcγ receptor (FcγR) and/or enhances Fc effector functions such as C1q binding, complement dependent cytotoxicity (CDC), antibody-dependent cell-mediated cytotoxicity (ADCC) and/or phagocytosis (ADCP).

Fc positions that may be mutated to increase binding of the protein to the activating FcγR and/or enhance Fc effector functions include positions 236, 239, 243, 256, 290, 292, 298, 300, 305, 312, 326, 330, 332, 333, 334, 345, 360, 339, 378, 396 or 430 (residue numbering according to the EU index). Exemplary mutations that may be made singularly or in combination are G236A, S239D, F243L, T256A, K290A, R292P, S298A, Y300L, V305L, K326A, A330K, I332E, E333A, K334A, A339T and P396L. Exemplary combination mutations that result in proteins with increased ADCC or ADCP are a S239D/I332E, S298A/E333A/K334A, F243L/R292P/Y300L, F243L/R292P/Y300L/P396L, F243L/R292P/Y300L/V305I/P396L and G236A/S239D/I332E.

Fc positions that may be mutated to enhance CDC include positions 267, 268, 324, 326, 333, 345 and 430. Exemplary mutations that may be made singularly or in combination are S267E, F1268F, S324T, K326A, K326W, E333A, E345K, E345Q, E345R, E345Y, E430S, E430F and E430T. Exemplary combination mutations that result in proteins with increased CDC are K326A/E333A, K326W/E333A, H268F/S324T, S267E/H268F, S267E/S324T and S267E/H268F/S324T.

The specific mutations described herein are mutations when compared to the IgG1, IgG2 and IgG4 wild-type amino acid sequences of SEQ ID NOs: 130, 131 and 132, respectively.

```
wild-type IgG1,
                                            SEQ ID NO: 130
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYMPPSRDELTKNQVSLTCL

VKGFYPSDIAVEWESNGQPENNYKTTPPVLDSDGSFFLYSKLTVDKSRWQ

QGNVFSCSVMHEALHNHYTQKSLSLSPGK wild-type IgG2;
                                            SEQ ID NO: 131
ASTKGPSVFPLAPCSRSTSESTAALGCLVKDYFPEPVTVSWNSGALTSGV

HTFPAVLQSSGLYSLSSVVTVPSSNFGTQTYTCNVDHKPSNTKVDKTVER

KCCVECPPCPAPPVAGPSVFLFPPKPKDTLMISRTPEVTCVVVDVSHEDP

EVQFNWYVDGVEVHNAKTKPREEQFNSTFRVVSVLTVVHQDWLNGKEYKC

KVSNKGLPAPIEKTISKTKGQPREPQVYTLPPSREEMTKNQVSLTCLVKG

FYPSDISVEWESNGQPENNYKTTPPMLDSDGSFFLYSKLTVDKSRWQQGN

VFSCSVMHEALHNHYTQKSLSLSPGK wild-type IgG4;
                                            SEQ ID NO: 132
ASTKGPSVFPLAPCSRSTSESTAALGCLVKDYFPEPVTVSWNSGALTSGV

HTFPAVLQSSGLYSLSSVVTVPSSSLGTKTYTCNVDHKPSNTKVDKRVES
```

```
-continued
KYGPPCPSCPAPEFLGGPSVFLFPPKPKDTLMISRTPEVTCVVVDVSQED

PEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVK

GFYPSDIAVEWESNGQPENNYKTTPPVLDSDGSFFLYSRLTVDKSRWQEG

NVFSCSVMHEALHNHYTQKSLSLSLGK
```

Binding of the antibody to FcγR or FcRn may be assessed on cells engineered to express each receptor using flow cytometry. In an exemplary binding assay, $2 \times 10^5$ cells per well are seeded in 96-well plate and blocked in BSA Stain Buffer (BD Biosciences, San Jose, USA) for 30 min at 4° C. Cells are incubated with a test antibody on ice for 1.5 hour at 4° C. After being washed twice with BSA stain buffer, the cells are incubated with R-PE labeled anti-human IgG secondary antibody (Jackson Immunoresearch Laboratories) for 45 min at 4° C. The cells are washed twice in stain buffer and then resuspended in 150 μL of Stain Buffer containing 1:200 diluted DRAQ7 live/dead stain (Cell Signaling Technology, Danvers, USA). PE and DRAQ7 signals of the stained cells are detected by Miltenyi MACSQuant flow cytometer (Miltenyi Biotec, Auburn, USA) using B2 and B4 channel respectively. Live cells are gated on DRAQ7 exclusion and the geometric mean fluorescence signals are determined for at least 10,000 live events collected. FlowJo software (Tree Star) is used for analysis. Data is plotted as the logarithm of antibody concentration versus mean fluorescence signals. Nonlinear regression analysis is performed.

Glycoengineering

The ability of the antigen binding domain that binds hK2 conjugated to the Ig constant region or to the fragment of the Ig constant region to mediate ADCC can be enhanced by engineering the Ig constant region or the fragment of the Ig constant region oligosaccharide component. Human IgG1 or IgG3 are N-glycosylated at Asn297 with the majority of the glycans in the well-known biantennary G0, G0F, G1, G1F, G2 or G2F forms. Ig constant region containing proteins may be produced by non-engineered CHO cells typically have a glycan fucose content of about at least 85%. The removal of the core fucose from the biantennary complex-type oligosaccharides attached to the antigen binding domain that binds hK2 conjugated to the Ig constant region or to the fragment of the Ig constant region enhances the ADCC of the protein via improved FcγRIIIa binding without altering antigen binding or CDC activity. Such proteins can be achieved using different methods reported to lead to the successful expression of relatively high defucosylated immunoglobulins bearing the biantennary complex-type of Fc oligosaccharides such as control of culture osmolality (Konno et al., *Cytotechnology* 64(249-65, 2012), application of a variant CHO line Lec13 as the host cell line (Shields et al., *J Biol Chem* 277:26733-26740, 2002), application of a variant CHO line EB66 as the host cell line (Olivier et al., *MAbs;* 2(4): 405-415, 2010; PMID: 20562582), application of a rat hybridoma cell line YB2/0 as the host cell line (Shinkawa et al., *J Biol Chem* 278:3466-3473, 2003), introduction of small interfering RNA specifically against the α 1,6-fucosyltrasferase (FUT8) gene (Mori et al., *Biotechnol Bioeng* 88:901-908, 2004), or coexpression of β-1,4-N-acetylglucosaminyltransferase III and Golgi α-mannosidase II or a potent alpha-mannosidase I inhibitor, kifunensine (Ferrara et al., *J Biol Chem* 281:5032-5036, 2006, Ferrara et al., *Biotechnol Bioeng* 93:851-861, 2006; Xhou et al. *Biotechnol Bioeng* 99:652-65, 2008).

In some embodiments, the antigen binding domain that binds hK2 conjugated to the Ig constant region or to the fragment of the Ig constant region of the disclosure has a biantennary glycan structure with fucose content of about between 1% to about 15%, for example about 15%, 14%, 13%, 12%, 11% 10%, 9%, 8%, 7%, 6%, 5%, 4%, 3%, 2% or 1%. In some embodiments, the antigen binding domain that binds hK2 conjugated to the Ig constant region or to the fragment of the Ig constant region has a glycan structure with fucose content of about 50%, 40%, 45%, 40%, 35%, 30%, 25%, or 20%.

"Fucose content" means the amount of the fucose monosaccharide within the sugar chain at Asn297. The relative amount of fucose is the percentage of fucose-containing structures related to all glycostructures. These may be characterized and quantified by multiple methods, for example: 1) using MALDI-TOF of N-glycosidase F treated sample (e.g. complex, hybrid and oligo- and high-mannose structures) as described in Int Pat. Publ. No. WO2008/077546 2); 2) by enzymatic release of the Asn297 glycans with subsequent derivatization and detection/quantitation by HPLC (UPLC) with fluorescence detection and/or HPLC-MS (UPLC-MS); 3) intact protein analysis of the native or reduced mAb, with or without treatment of the Asn297 glycans with Endo S or other enzyme that cleaves between the first and the second GlcNAc monosaccharides, leaving the fucose attached to the first GlcNAc; 4) digestion of the mAb to constituent peptides by enzymatic digestion (e.g., trypsin or endopeptidase Lys-C), and subsequent separation, detection and quantitation by HPLC-MS (UPLC-MS); 5) Separation of the mAb oligosaccharides from the mAb protein by specific enzymatic deglycosylation with PNGase F at Asn 297. The oligosaccharides thus released can be labeled with a fluorophore, separated and identified by various complementary techniques which allow: fine characterization of the glycan structures by matrix-assisted laser desorption ionization (MALDI) mass spectrometry by comparison of the experimental masses with the theoretical masses, determination of the degree of sialylation by ion exchange HPLC (GlycoSep C), separation and quantification of the oligosaccharide forms according to hydrophilicity criteria by normal-phase HPLC (GlycoSep N), and separation and quantification of the oligosaccharides by high performance capillary electrophoresis-laser induced fluorescence (HPCE-LIF).

"Low fucose" or "low fucose content" as used herein refers to the antigen binding domain that bind hK2 conjugated to the Ig constant region or to the fragment of the Ig constant region with fucose content of about between 1%-15%.

"Normal fucose" or 'normal fucose content" as used herein refers to the antigen binding domain that bind hK2 conjugated to the Ig constant region or to the fragment of the Ig constant region with fucose content of about over 50%, typically about over 80% or over 85%.

Anti-Idiotypic Antibodies

Anti-idiotypic antibodies are antibodies that specifically bind to the antigen binding domain that binds hK2 of the disclosure.

The invention also provides an anti-idiotypic antibody that specifically binds to the antigen binding domain that binds hK2 of the disclosure.

The invention also provides an anti-idiotypic antibody that specifically binds to the antigen binding domain that binds hK2 comprising the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169;
the VH of SEQ ID NO: 204 and the VL of SEQ ID NO: 205.
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 4 and the VL of SEQ ID NO: 140;
the VH of SEQ ID NO: 4 and the VL of SEQ ID NO: 160;
the VH of SEQ ID NO: 5 and the VL of SEQ ID NO: 1;
the VH of SEQ ID NO: 5 and the VL of SEQ ID NO: 3;
the VH of SEQ ID NO: 5 and the VL of SEQ ID NO: 140;
the VH of SEQ ID NO: 5 and the VL of SEQ ID NO: 160;
the VH of SEQ ID NO: 6 and the VL of SEQ ID NO: 1;
the VH of SEQ ID NO: 6 and the VL of SEQ ID NO: 2;
the VH of SEQ ID NO: 6 and the VL of SEQ ID NO: 3;
the VH of SEQ ID NO: 6 and the VL of SEQ ID NO: 140;
the VH of SEQ ID NO: 6 and the VL of SEQ ID NO: 160;
the VH of SEQ ID NO: 139 and the VL of SEQ ID NO: 1;
the VH of SEQ ID NO: 139 and the VL of SEQ ID NO: 2;
the VH of SEQ ID NO: 139 and the VL of SEQ ID NO: 3;
the VH of SEQ ID NO: 139 and the VL of SEQ ID NO: 140;
the VH of SEQ ID NO: 139 and the VL of SEQ ID NO: 160;
the VH of SEQ ID NO: 159 and the VL of SEQ ID NO: 1;
the VH of SEQ ID NO: 159 and the VL of SEQ ID NO: 2;
the VH of SEQ ID NO: 159 and the VL of SEQ ID NO: 3;
the VH of SEQ ID NO: 159 and the VL of SEQ ID NO: 140;
the VH of SEQ ID NO: 159 and the VL of SEQ ID NO: 160;
the VH of SEQ ID NO: 161 and the VL of SEQ ID NO: 1;
the VH of SEQ ID NO: 161 and the VL of SEQ ID NO: 2;
the VH of SEQ ID NO: 161 and the VL of SEQ ID NO: 3;
the VH of SEQ ID NO: 161 and the VL of SEQ ID NO: 140;
or
the VH of SEQ ID NO: 161 and the VL of SEQ ID NO: 160.

An anti-idiotypic (Id) antibody is an antibody which recognizes the antigenic determinants (e.g. the paratope or CDRs) of the antibody. The Id antibody may be antigen-blocking or non-blocking. The antigen-blocking Id may be used to detect the free antigen binding domain in a sample (e.g. the antigen binding domain that binds hK2 of the disclosure). The non-blocking Id may be used to detect the total antibody (free, partially bond to antigen, or fully bound to antigen) in a sample. An Id antibody may be prepared by immunizing an animal with the antibody to which an anti-Id is being prepared.

An anti-Id antibody may also be used as an immunogen to induce an immune response in yet another animal, producing a so-called anti-anti-Id antibody. An anti-anti-Id may be epitopically identical to the original antigen binding domain which induced the anti-Id. Thus, by using antibodies to the idiotypic determinants of the antigen binding domain, it is possible to identify other clones expressing antigen binding domains of identical specificity. Anti-Id antibodies may be varied (thereby producing anti-Id antibody variants) and/or derivatized by any suitable technique, such as those described elsewhere herein.

Immunoconjugates

The antigen binding domains that bind hK2 of the disclosure, the proteins comprising the antigen binding domains that bind hK2 or the multispecific proteins that comprise the antigen binding domains that bind hK2 (collectively referred herein as to hK2 binding proteins) may be conjugated to a heterologous molecule. hK2 binding protein also includes chimeric antigen receptors (CAR) which comprises the antigen biding domains that bind hK2 of the disclosure.

In some embodiments, the heterologous molecule is a detectable label or a cytotoxic agent.

The invention also provides an antigen binding domain that binds hK2 conjugated to a detectable label.

The invention also provides a protein comprising an antigen binding domain that binds hK2 conjugated to a detectable label.

The invention also provides a multispecific protein comprising an antigen binding domain that binds hK2 conjugated to a detectable label.

The invention also provides a CAR comprising an antigen binding domain that binds hK2 conjugated to a detectable label.

The invention also provides an antigen binding domain that binds hK2 conjugated to a cytotoxic agent.

The invention also provides a protein comprising an antigen binding domain that binds hK2 conjugated to a cytotoxic agent.

The invention also provides a multispecific protein comprising an antigen binding domain that binds hK2 conjugated to a cytotoxic agent.

The invention also provides a CAR comprising an antigen binding domain that binds hK2 conjugated to a cytotoxic agent.

hK2 binding proteins of the disclosure may be used to direct therapeutics to hK2 expressing cells. such as prostate or breast cancer cells. Alternatively, hK2 expressing cells may be targeted with a hK2 binding protein of the disclosure coupled to a therapeutic intended to modify cell function once internalized.

In some embodiments, the detectable label is also a cytotoxic agent.

The hK2 binding proteins of the disclosure conjugated to a detectable label may be used to evaluate expression of hK2 on a variety of samples.

Detectable label includes compositions that when conjugated to the hK2 binding proteins of the disclosure renders the latter detectable, via spectroscopic, photochemical, biochemical, immunochemical, or chemical means.

Exemplary detectable labels include radioactive isotopes, magnetic beads, metallic beads, colloidal particles, fluorescent dyes, electron-dense reagents, enzymes (for example, as commonly used in an ELISA), biotin, digoxigenin, haptens, luminescent molecules, chemiluminescent molecules, fluorochromes, fluorophores, fluorescent quenching agents, colored molecules, radioactive isotopes, scintillates, avidin, streptavidin, protein A, protein G, antibodies or fragments thereof, polyhistidine, $Ni^{2+}$, Flag tags, myc tags, heavy metals, enzymes, alkaline phosphatase, peroxidase, luciferase, electron donors/acceptors, acridinium esters, and colorimetric substrates.

A detectable label may emit a signal spontaneously, such as when the detectable label is a radioactive isotope. In other cases, the detectable label emits a signal as a result of being stimulated by an external field.

Exemplary radioactive isotopes may be γ-emitting, Auger-emitting, β-emitting, an alpha-emitting or positron-emitting radioactive isotope. Exemplary radioactive isotopes include $^3H$, $^{11}C$, $^{13}C$, $^{15}N$, $^{18}F$, $^{19}F$, $^{55}Co$, $^{57}Co$, $^{60}Co$, $^{61}Cu$, $^{62}Cu$, $^{64}Cu$, $^{67}Cu$, $^{68}Ga$, $^{72}As$, $^{75}Br$, $^{86}Y$, $^{89}Zr$, $^{90}Sr$, $^{94m}Tc$, $^{99m}Tc$, $^{115}In$, $^{124}I$, $^{125}I$, $^{131}I$, $^{211}At$, $^{212}Bi$, $^{213}Bi$, $^{223}Ra$, $^{226}Ra$, $^{225}Ac$ and $^{227}Ac$.

Exemplary metal atoms are metals with anatomic number greater than 20, such as calcium atoms, scandium atoms, titanium atoms, vanadium atoms, chromium atoms, manganese atoms, iron atoms, cobalt atoms, nickel atoms, copper atoms, zinc atoms, gallium atoms, germanium atoms, arsenic atoms, selenium atoms, bromine atoms, krypton atoms, rubidium atoms, strontium atoms, yttrium atoms, zirconium atoms, niobium atoms, molybdenum atoms, technetium atoms, ruthenium atoms, rhodium atoms, palladium atoms, silver atoms, cadmium atoms, indium atoms, tin atoms, antimony atoms, tellurium atoms, iodine atoms, xenon atoms, cesium atoms, barium atoms, lanthanum atoms, hafnium atoms, tantalum atoms, tungsten atoms, rhenium atoms, osmium atoms, iridium atoms, platinum atoms, gold atoms, mercury atoms, thallium atoms, lead atoms, bismuth atoms, francium atoms, radium atoms, actinium atoms, cerium atoms, praseodymium atoms, neodymium atoms, promethium atoms, samarium atoms, europium atoms, gadolinium atoms, terbium atoms, dysprosium atoms, holmium atoms, erbium atoms, thulium atoms, ytterbium atoms, lutetium atoms, thorium atoms, protactinium atoms, uranium atoms, neptunium atoms, plutonium atoms, americium atoms, curium atoms, berkelium atoms, californium atoms, einsteinium atoms, fermium atoms, mendelevium atoms, nobelium atoms, or lawrencium atoms.

In some embodiments, the metal atoms may be alkaline earth metals with anatomic number greater than twenty.

In some embodiments, the metal atoms may be lanthanides.

In some embodiments, the metal atoms may be actinides.

In some embodiments, the metal atoms may be transition metals.

In some embodiments, the metal atoms may be poor metals.

In some embodiments, the metal atoms may be gold atoms, bismuth atoms, tantalum atoms, and gadolinium atoms.

In some embodiments, the metal atoms may be metals with anatomic number of 53 (i.e. iodine) to 83 (i.e. bismuth).

In some embodiments, the metal atoms may be atoms suitable for magnetic resonance imaging.

The metal atoms may be metal ions in the form of +1, +2, or +3 oxidation states, such as $Ba^{2+}$, $Bi^{3+}$, $Cs^+$, $Ca^{2+}$, $Cr^{2+}$, $Cr^{3+}$, $Cr^{6+}$, $Co^{2+}$, $Co^{3+}$, $Cu^+$, $Cu^{2+}$, $Cu^{3+}$, $Ga^{3+}$, $Gd^{3+}$, $Au^+$, $Au^{3+}$, $Fe^{2+}$, $Fe^{3+}$, $F^{3+}$, $Pb^{2+}$, $Mn^{2+}$, $Mn^{3+}$, $Mn^{4+}$, $Mn^{7+}$, $Hg^{2+}$, $Ni^{2+}$, $Ni^{3+}$, $Ag^+$, $Sr^{2+}$, $Sn^{2+}$, $Sn^{4+}$, and $Zn^{2+}$. The metal atoms may comprise a metal oxide, such as iron oxide, manganese oxide, or gadolinium oxide.

Suitable dyes include any commercially available dyes such as, for example, 5(6)-carboxyfluorescein, IRDye 680RD maleimide or IRDye 800CW, ruthenium polypyridyl dyes, and the like.

Suitable fluorophores are fluorescein isothiocyanate (FITC), fluorescein thiosemicarbazide, rhodamine, Texas Red, CyDyes (e.g., Cy3, Cy5, Cy5.5), Alexa Fluors (e.g., Alexa488, Alexa555, Alexa594; Alexa647), near infrared (NIR) (700-900 nm) fluorescent dyes, and carbocyanine and aminostyryl dyes.

The antigen binding domain that binds hK2 conjugated to a detectable label may be used as an imaging agent.

The protein comprising an antigen binding domain that binds hK2 conjugated to a detectable label may be used as an imaging agent.

The multispecific protein comprising an antigen binding domain that binds hK2 conjugated to a detectable label may be used as an imaging agent.

The CAR comprising an antigen binding domain that binds hK2 conjugated to a detectable label may be used as an imaging agent.

In some embodiments, the cytotoxic agent is a chemotherapeutic agent, a drug, a growth inhibitory agent, a toxin (e.g., an enzymatically active toxin of bacterial, fungal, plant, or animal origin, or fragments thereof), or a radioactive isotope (i.e., a radioconjugate).

In some embodiments, the cytotoxic agent is daunomycin, doxorubicin, methotrexate, vindesine, bacterial toxins such as diphtheria toxin, ricin, geldanamycin, maytansinoids or calicheamicin. The cytotoxic agent may elicit their cytotoxic and cytostatic effects by mechanisms including tubulin binding, DNA binding, or topoisomerase inhibition.

In some embodiments, the cytotoxic agent is an enzymatically active toxin such as diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In some embodiments, the cytotoxic agent is a radionuclide, such as $^{212}$Bi, $^{131}$I, $^{131}$In, $^{90}$Y, and $^{186}$Re.

In some embodiments, the cytotoxic agent is dolastatins or dolostatin peptidic analogs and derivatives, auristatin or monomethyl auristatin phenylalanine. Exemplary molecules are disclosed in U.S. Pat. Nos. 5,635,483 and 5,780,588. Dolastatins and auristatins have been shown to interfere with microtubule dynamics, GTP hydrolysis, and nuclear and cellular division (Woyke et al (2001) Antimicrob Agents and Chemother. 45(12):3580-3584) and have anticancer and antifungal activity. The dolastatin or auristatin drug moiety may be attached to the antibody of the invention through the N (amino) terminus or the C (carboxyl) terminus of the peptidic drug moiety (WO02/088172), or via any cysteine engineered into the antibody.

The hK2 binding proteins of the disclosure may be conjugated to a detectable label using known methods.

In some embodiments, the detectable label is complexed with a chelating agent.

In some embodiments, the detectable label is conjugated to the hK2 binding proteins of the disclosure via a linker.

The detectable label or the cytotoxic moiety may be linked directly, or indirectly, to the hK2 binding proteins of the disclosure using known methods. Suitable linkers are known in the art and include, for example, prosthetic groups, non-phenolic linkers (derivatives of N-succimidyl-benzoates; dodecaborate), chelating moieties of both macrocyclics and acyclic chelators, such as derivatives of 1,4,7,10-tetraazacyclododecane-1,4,7,10,tetraacetic acid (DOTA), derivatives of diethylenetriaminepentaacetic avid (DTPA), derivatives of S-2-(4-Isothiocyanatobenzyl)-1,4,7-triazacyclononane-1,4,7-triacetic acid (NOTA) and derivatives of 1,4,8,11-tetraazacyclodocedan-1,4,8,11-tetraacetic acid (TETA), N-succinimidyl-3-(2-pyridyldithiol) propionate (SPDP), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis(p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene) and other chelating moieties. Suitable peptide linkers are well known.

In some embodiments, the hK2 binding proteins of the disclosure is removed from the blood via renal clearance.

Kit

The invention also provides a kit comprising the antigen binding domain that binds hK2.

The invention also provides a kit comprising the protein comprising an antigen binding domain that binds hK2.

The invention also provides a kit comprising the multispecific protein comprising an antigen binding domain that binds hK2.

The invention also provides a kit comprising the CAR comprising an antigen binding domain that binds hK2.

The kit may be used for therapeutic uses and as diagnostic kits.

The kit may be used to detect the presence of hK2 in a sample.

In some embodiments, the kit comprises the hK2 binding protein of the disclosure and reagents for detecting the hK2 binding protein. The kit can include one or more other elements including: instructions for use; other reagents, e.g., a label, a therapeutic agent, or an agent useful for chelating, or otherwise coupling, an antibody to a label or therapeutic agent, or a radioprotective composition; devices or other materials for preparing the antibody for administration; pharmaceutically acceptable carriers; and devices or other materials for administration to a subject.

In some embodiments, the kit comprises the antigen binding domain that binds hK2 in a container and instructions for use of the kit.

In some embodiments, the kit comprises the protein comprising an antigen binding domain that binds hK2 in a container and instructions for use of the kit.

In some embodiments, the kit comprises the multispecific protein comprising an antigen binding domain that binds hK2 in a container and instructions for use of the kit.

In some embodiments, the antigen binding domain that binds hK2 in the kit is labeled.

In some embodiments, the protein comprising an antigen binding domain that binds hK2 in the kit is labeled.

In some embodiments, the multispecific protein comprising an antigen binding domain that binds hK2 in the kit is labeled.

In some embodiments, the kit comprises the antigen binding domain that binds hK2 comprising
the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169;
the VH of SEQ ID NO: 204 and the VL of SEQ ID NO: 205.
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 4 and the VL of SEQ ID NO: 140;
the VH of SEQ ID NO: 4 and the VL of SEQ ID NO: 160;
the VH of SEQ ID NO: 5 and the VL of SEQ ID NO: 1;
the VH of SEQ ID NO: 5 and the VL of SEQ ID NO: 3;
the VH of SEQ ID NO: 5 and the VL of SEQ ID NO: 140;
the VH of SEQ ID NO: 5 and the VL of SEQ ID NO: 160;
the VH of SEQ ID NO: 6 and the VL of SEQ ID NO: 1;
the VH of SEQ ID NO: 6 and the VL of SEQ ID NO: 2;
the VH of SEQ ID NO: 6 and the VL of SEQ ID NO: 3;
the VH of SEQ ID NO: 6 and the VL of SEQ ID NO: 140;
the VH of SEQ ID NO: 6 and the VL of SEQ ID NO: 160;
the VH of SEQ ID NO: 139 and the VL of SEQ ID NO: 1;
the VH of SEQ ID NO: 139 and the VL of SEQ ID NO: 2;
the VH of SEQ ID NO: 139 and the VL of SEQ ID NO: 3;
the VH of SEQ ID NO: 139 and the VL of SEQ ID NO: 140;
the VH of SEQ ID NO: 139 and the VL of SEQ ID NO: 160;

the VH of SEQ ID NO: 159 and the VL of SEQ ID NO: 1;
the VH of SEQ ID NO: 159 and the VL of SEQ ID NO: 2;
the VH of SEQ ID NO: 159 and the VL of SEQ ID NO: 3;
the VH of SEQ ID NO: 159 and the VL of SEQ ID NO: 140;
the VH of SEQ ID NO: 159 and the VL of SEQ ID NO: 160;
the VH of SEQ ID NO: 161 and the VL of SEQ ID NO: 1;
the VH of SEQ ID NO: 161 and the VL of SEQ ID NO: 2;
the VH of SEQ ID NO: 161 and the VL of SEQ ID NO: 3;
the VH of SEQ ID NO: 161 and the VL of SEQ ID NO: 140; or
the VH of SEQ ID NO: 161 and the VL of SEQ ID NO: 160.

In a particular embodiment, the kit comprises the antigen binding domain that binds hK2 comprising a VH of SEQ ID NO: 162 and a VL of SEQ ID NO: 163.

In some embodiments, the kit comprises the antigen binding domain that binds hK2 comprising SEQ ID NOs: 8, 9, 10, 11, 12, 13, 14, 15, 16, 17, 18, 19, 20, 21, 22, 23, 133, 134, 135, 136, 308, 316, 318, 319, 320, 321, 322, 323, 324, 325, 404, 405, 406, 407, 408, or 409.

Methods of Detecting hK2

The invention also provides a method of detecting hK2 in a sample, comprising obtaining the sample, contacting the sample with the antigen binding domain that binds hK2 of the disclosure and detecting the bound hK2 in the sample.

In some embodiments, the sample may be derived from urine, blood, serum, plasma, saliva, ascites, circulating cells, synovial fluid, circulating cells, cells that are not tissue associated (i.e., free cells), tissues (e.g., surgically resected tissue, biopsies, including fine needle aspiration), histological preparations, and the like.

The antigen binding domain that binds hK2 of the disclosure may be detected using known methods. Exemplary methods include direct labeling of the antibodies using fluorescent or chemiluminescent labels, or radiolabels, or attaching to the antibodies of the invention a moiety which is readily detectable, such as biotin, enzymes or epitope tags. Exemplary labels and moieties are ruthenium, $^{111}$In-DOTA, $^{111}$In-diethylenetriaminepentaacetic acid (DTPA), horseradish peroxidase, alkaline phosphatase and beta-galactosidase, poly-histidine (HIS tag), acridine dyes, cyanine dyes, fluorone dyes, oxazin dyes, phenanthridine dyes, rhodamine dyes and Alexafluor® dyes.

The antigen binding domain that binds hK2 of the disclosure may be used in a variety of assays to detect hK2 in the sample. Exemplary assays are western blot analysis, radioimmunoassay, surface plasmon resonance, immunoprecipitation, equilibrium dialysis, immunodiffusion, electrochemiluminescence (ECL) immunoassay, immunohistochemistry, fluorescence-activated cell sorting (FACS) or ELISA assay.

Chimeric Antigen Receptors (CAR) Comprising the Antigen Binding Domains that Bind hK2 of the Disclosure Any of the antigen binding domains that bind hK2 identified herein may be engineered into a chimeric antigen receptor (CAR) to provide CARs that bind hK2. The disclosure provides for CARs that target hK2, cells comprising such CARs, and methods of treating hK2 producing cancer, such as prostate cancer, using the CARs described herein.

The CARs of the invention have antigen specificity for hK2. The phrases "have antigen specificity" and "elicit antigen-specific response" as used herein mean that the CAR can specifically bind to and immunologically recognize an antigen, such that binding of the CAR to the hK2 antigen elicits an immune response. Methods of testing the CARs for antigen specificity and for the ability to recognize target cells are known in the art.

The disclosure relates to the use of T cells which have been genetically modified to stably express a desired chimeric antigen receptor. A chimeric antigen receptor (CAR) is an artificially constructed heterologous protein or polypeptide containing an antigen binding domain of an antibody (such as scFv) linked to a T-cell signaling domain. Characteristics of CARs include their ability to redirect T-cell specificity and reactivity toward a selected target in a non-MHC-restricted manner, exploiting the antigen-binding properties of monoclonal antibodies. The non-MHC-restricted antigen recognition gives T cells expressing CARs the ability to recognize antigens independent of antigen processing, thus bypassing a major mechanism of tumor evasion. Moreover, when expressed in T-cells, CARs advantageously do not dimerize with endogenous T cell receptor (TCR) alpha and beta chains.

The CARs described herein provide recombinant polypeptide constructs comprising at least an extracellular antigen binding domain, a transmembrane domain and an intracellular signaling domain (also referred to herein as a cytoplasmic signaling domain) comprising a functional signaling domain derived from a stimulatory molecule as described herein. T cells expressing a CAR are referred to herein as CAR T cells, CAR-T cells or CAR modified T cells, and these terms are used interchangeably herein. The cell can be genetically modified to stably express an antibody binding domain on its surface, conferring novel antigen specificity that is MHC independent.

In some instances, the T cell is genetically modified to stably express a CAR that combines an antigen recognition domain of an antibody with an intracellular domain of the CD3-zeta chain or FcγRI protein into a single chimeric protein. In one embodiment, the stimulatory molecule is the zeta chain associated with the T cell receptor complex.

An "intracellular signaling domain," refers to an intracellular portion of a molecule. It is the functional portion of the protein which acts by transmitting information within the cell to regulate cellular activity via defined signaling pathways by generating second messengers or functioning as effectors by responding to such messengers. The intracellular signaling domain generates a signal that promotes an immune effector function of the CAR containing cell, e.g., a CAR-T cell. Examples of immune effector function. e.g., in a CAR-T cell, include cytolytic activity and helper activity, including the secretion of cytokines.

In one embodiment, the intracellular signaling domain comprises a primary intracellular signaling domain. Exemplary primary intracellular signaling domains include those derived from the molecules responsible for primary stimulation, or antigen dependent simulation. In one embodiment, the intracellular signaling domain comprises a co-stimulatory intracellular domain. Exemplary co-stimulatory intracellular signaling domains include those derived from molecules responsible for co-stimulatory signals, or antigen independent stimulation. F or example, in the case of a CAR-T, a primary intracellular signaling domain comprises a cytoplasmic sequence of a T cell receptor, and a co-stimulatory intracellular signaling domain comprises a cytoplasmic sequence from co-receptor or co-stimulatory molecule.

A primary intracellular signaling domain comprises a signaling motif which is known as an immunoreceptor tyrosine-based activation motif or ITAM. Exemplary ITAM containing primary cytoplasmic signaling sequences include those derived from CD3-zeta, FcRγ, FcR beta, CD3γ, CD3δ, CD3ε, CD5, CD22, CD79a, CD79b, CD66d, DAP10 and DAP12.

The term "zeta" or alternatively "zeta chain", "CD3-zeta" or "TCR-zeta" is defined as the protein provided as GenBank Ace. No. BAG36664.1, or the equivalent residues from a nonhuman species, e.g., murine, rabbit, primate, mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect, the cytoplasmic domain of zeta comprises residues 52 through 164 of GenBank Ace. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO: 28, or a sequence having at least 50%, at least 55%, at least 60%, at least 65%, at least 70%, at least 75%, at least 80%, at least 85%, at least 90%, at least 95%, at least 98% or at least 99%, sequence identity with SEQ ID NO: 28.

```
CD3-zeta stimulatory domain
                                           SEQ ID NO: 28
RVKFSRSADAPAYKQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR
```

The term "co-stimulatory molecule" refers to the cognate binding partner on a T cell that specifically binds with a co-stimulatory ligand, thereby mediating a co-stimulatory response by the T cell, such as, but not limited to, proliferation. Co-stimulatory molecules are cell surface molecules other than antigen receptors or their ligands that are required for an efficient immune response. Co-stimulatory molecules include, but are not limited to an MHC class 1 molecule, BTLA and a Toll ligand receptor, as well as OX40, CD2, CD27, CD28, CDS, ICAM-1, LFA-1 (CD11a/CD18) and 4-1BB (CD137).

A co-stimulatory intracellular signaling domain can be the intracellular portion of a co-stimulatory molecule. A co-stimulatory molecule can be represented in the following protein families: TNF receptor proteins, Immunoglobulin-like proteins, cytokine receptors, integrins, signaling lymphocytic activation molecules (SLAM proteins), and activating NK cell receptors. Exemplary such molecules include CD27, CD28, 4-1BB (CD137), OX40, GITR, CD30, MyD88, CD40, ICOS, BAFFR, HVEM, lymphocyte function-associated antigen-1 (LFA-1), CD2, CD7, LIGHT, NKG2C, SLAMF7, NKp80, CD160, B7-H3, and a ligand that specifically binds with CD83, and the like.

The intracellular signaling domain can comprise the entire intracellular portion, or the entire native intracellular signaling domain, of the molecule from which it is derived, or a functional fragment thereof.

The term "4-1BB" or alternatively "CD137" refers to a member of the TNFR superfamily with an amino acid sequence provided as GenBank Acc. No. AAA62478.2, or the equivalent residues from a nonhuman species, e.g., mouse, rodent, monkey, ape and the like; and a "4-1BB co-stimulatory domain" is defined as amino acid residues 214-255 of GenBank Acc. accession no. AAA62478.2, or the equivalent residues from a non-human species, e.g., mouse, rodent, monkey, ape and the like. In one aspect, the "4-1BB co-stimulatory domain" or "CD137 co-stimulatory domain" is the sequence provided as SEQ ID NO: 27 (KRGRKKL-LYIFKQPFMRPVQTTQEEDGCSCRFPEEEEGGCEL; SEQ ID NO: 27) or the equivalent residues from a non-human species, e.g., mouse, rodent, monkey, ape and the like, or a sequence having at least 50%, at least 55%, at least 60%, at least 65%, at least 70%, at least 75%, at least 80%, at least 85%, at least 90%, at least 95%, at least 98% or at least 99% sequence identity with SEQ ID NO: 27.

In one embodiment, a transmembrane domain that is naturally associated with one of the other domains in the CAR is used. In another embodiment, the transmembrane domain can be selected or modified by amino acid substitution to avoid binding of such domains to the transmembrane domains of the same or different surface membrane proteins to minimize interactions with other members of the receptor complex. In one embodiment, the transmembrane domain comprises the CD8α hinge domain.

In some embodiments, the cytoplasmic signaling domain further comprises one or more functional signaling domains derived from at least one co-stimulatory molecule as defined herein. In one embodiment, the co-stimulatory molecule is chosen from 4-1BB (i.e., CD137), CD27, CD3-zeta and/or CD28. CD28 is a T cell marker important in T cell co-stimulation. CD27 is a member of the tumor necrosis factor receptor superfamily and acts as a co-stimulatory immune checkpoint molecule. 4-1BB transmits a potent co-stimulatory signal to T cells, promoting differentiation and enhancing long-term survival of T lymphocytes. CD3-zeta associates with TCRs to produce a signal and contains immunoreceptor tyrosine-based activation motifs (ITAMs). In another embodiment, the co-stimulatory molecule is MyD88 or CD40.

In one embodiment, the CAR comprises an intracellular hinge domain comprising CD8 and an intracellular T cell receptor signaling domain comprising CD28, 4-1BB, and CD3-zeta. In another embodiment, the CAR comprises an intracellular hinge domain and an intracellular T cell receptor signaling domain comprising CD28, 4-1BB, and CD3-zeta, wherein the hinge domain comprises all or part of the extracellular region of CD8, CD4 or CD28; all or part of an antibody constant region; all or part of the FcγRIIIA receptor, an IgG hinge, an IgM hinge, an IgA hinge, an IgD hinge, an IgE hinge, or an Ig hinge. The IgG hinge may be from IgG1, IgG2, IgG3, IgG4, IgM1, IgM2, IgA1, IgA2, IgD, IgE, or a chimera thereof.

CARs described herein provide recombinant polypeptide constructs comprising at least an extracellular antigen binding domain, a transmembrane domain and an intracellular signaling domain (also referred to herein as "a cytoplasmic signaling domain") comprising, e.g., a functional signaling domain derived from a stimulatory molecule as defined below In one embodiment, the CAR comprises a chimeric fusion protein comprising an extracellular antigen recognition domain, a transmembrane domain and an intracellular signaling domain comprising a functional signaling domain derived from a stimulatory molecule. In one embodiment, the CAR comprises a chimeric fusion protein comprising an extracellular antigen recognition domain, a transmembrane domain and an intracellular signaling domain comprising a functional signaling domain derived from a co-stimulatory molecule and a functional signaling domain derived from a stimulatory molecule. In one embodiment, the CAR comprises a chimeric fusion protein comprising an extracellular antigen recognition domain, a transmembrane domain and an intracellular signaling domain comprising at least two functional signaling domains derived from one or more co-stimulatory molecule(s) and a functional signaling domain derived from a stimulatory molecule.

The CARs of the disclosure can be designed to comprise the CD28 and/or 4-1BB signaling domain by itself or be combined with any other desired cytoplasmic domain(s) useful in the context of the CARs of the invention. In one embodiment, the cytoplasmic domain of the CAR can further comprise the signaling domain of CD3-zeta. For example, the cytoplasmic domain of the CAR can include but is not limited to CD3-zeta, 4-1BB and CD28 signaling modules and combinations thereof. Accordingly, the invention provides CAR T cells and methods of their use for adoptive therapy.

The disclosure further provides variants, e.g., functional variants, of the CARs. The term "functional variant" as used herein refers to a CAR having substantial or significant sequence identity or similarity to a parent CAR which functional variant retains the biological activity of the CAR for which it is a variant. Functional variants encompass, e.g., those variants of the CAR that retain the ability to recognize target cells to a similar extent, the same extent, or to a higher extent, as the parent CAR. In reference to the parent CAR, the functional variant can, for example, be at least about 30%, about 40%, about 50%, about 60%, about 75%, about 80%, about 85%, about 90%, about 91%, about 92%, about 93%, about 94%, about 95%, about 96%, about 97%, about 98%, about 99% or more identical in amino acid sequence to the parent CAR.

A functional variant can, for example, comprise the amino acid sequence of the parent CAR with at least one conservative amino acid substitution. In one embodiment, the functional variant comprises the amino acid sequence of the parent CAR with at least one non-conservative amino acid substitution. In this case, the non-conservative amino acid substitution may not interfere with or inhibit the biological activity of the functional variant. The non-conservative amino acid substitution may enhance the biological activity of the functional variant such that the biological activity of the functional variant is increased as compared to the parent CAR.

Conservative amino acid substitutions are known in the art and described herein.

The CAR of the disclosure can consist essentially of the specified amino acid sequence or sequences described herein, such that other components e.g., other amino acids, do not materially change the biological activity of the functional variant.

The CARs of the disclosure (including functional portions and functional variants) can be of any length, i.e., can comprise any number of amino acids, provided that the CARs (or functional portions or functional variants thereof) retain their biological activity, e.g., the ability to specifically bind to an antigen, detect diseased cells (e.g., cancer cells) in a host, or treat or prevent disease in a host, etc. For example, the CARs can be about 50 to about 5000 amino acids long, such as about 50, about 70, about 75, about 100, about 125, about 150, about 175, about 200, about 225, about 250, about 275, about 300, about 325, about 350, about 375, about 400, about 425, about 450, about 475, about 500, about 525, about 550, about 575, about 600, about 625, about 650, about 675, about 700, about 725, about 750, about 775, about 800, about 825, about 850, about 875, about 900, about 925, about 950, about 975, about 1000 or more amino acids in length.

The CARs of the disclosure (including functional portions and functional variants of the invention) may comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, α-(2-amino-2-norbornane)-carboxylic acid, α,γ-diaminobutyric acid, α,β-diaminopropionic acid, homophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, indoline-2-carboxylic acid, 1,2,3,4-tetrahydroisoquinoline-3-carboxylic acid, aminomalonic acid, aminomalonic acid monoamide, and α-tert-butylglycine.

The CARs of the disclosure (including functional portions and functional variants) can be subject to post-translational modifications. They can be glycosylated, esterified, N-acylated, amidated, carboxylated, phosphorylated, esterified, cyclized via, e.g., a disulfide bridge, or converted into an acid addition salt. In some embodiments, they are dimerized or polymerized, or conjugated.

The CARs of the disclosure (including functional portions and functional variants thereof) can be obtained by methods known in the art. Suitable methods of de novo synthesizing polypeptides and proteins are described in references, such as Chan et al., *Fmoc Solid Phase Peptide Synthesis*, Oxford University Press, Oxford, United Kingdom, 2000; Peptide and Protein Drug Analysis, ed. Reid, R., Marcel Dekker, Inc., 2000; and *Epitope Mapping*, ed. Westwood et al., Oxford University Press, Oxford. United Kingdom, 2001. Also, the CARs can be recombinantly produced using the nucleic acids described herein using standard recombinant methods. Further, some of the CARs (including functional portions and functional variants thereof) can be isolated and/or purified from a source, such as a plant, a bacterium, an insect, a mammal, etc. Methods of isolation and purification are known in the art. Alternatively, the CARs, of the disclosure (including functional portions and functional variants thereof) can be commercially synthesized. In this respect, the CARs, polypeptides, and proteins can be synthetic, recombinant, isolated, and/or purified.

The disclosure also provides an antibody or an antigen binding fragment thereof that binds to an epitope of the CAR of the disclosure. The antibody or the antigen binding fragment thereof may have any level of affinity or avidity for the functional portion of the CAR. In some embodiments, the antibody or the antigen binding fragment may bind hK2 with a range of affinities ($K_D$). In one embodiment the antibody binds to hK2 with the $K_D$ equal to or less than about $10^{-7}$ M, such as but not limited to, 1-9.9 (or any range or value therein, such as 1, 2, 3, 4, 5, 6, 7, 8, or 9)$\times 10^{-8}$ M, $10^{-9}$ M, $10^{-10}$ M, $10^{-11}$ M, $10^{-12}$ M, $10^{-13}$ M, $10^{-14}$ M, $10^{-15}$ M or any range or value therein, as determined by surface plasmon resonance or the Kinexa method, as practiced by those of skill in the art. One exemplary affinity is equal to or less than $1\times10^{-8}$ M. Another exemplary affinity is equal to or less than $1\times10^{-9}$ M.

Methods of testing antibodies for their ability to bind to any functional portion of the CARs of the disclosure are known in the art and include any antibody-antigen binding assay, such as, for example, radioimmunoassay (RIA), Western blot, enzyme-linked immunosorbent assay (ELISA), immunoprecipitation, and competitive inhibition assays.

The portion of the CAR comprising an antibody or antibody fragment thereof may exist in a variety of forms where the antigen binding domain is expressed as part of a contiguous polypeptide chain including, for example, a single domain antibody fragment (sdAb), a scFv and a human chimeric or humanized antibody (Harlow et al., 1999, *In: Using Antibodies: A Laboratory Manual*, Cold Spring Harbor Laboratory Press, N.Y.; Harlow et al., 1989, *In: Antibodies: A Laboratory Manual*, Cold Spring Harbor, N.Y.; Houston et al., 1988, *Proc. Natl. Acad. Sci. USA* 85:5879-5883; Bird et al., 1988, *Science* 242:423-426). In one aspect, the antigen binding domain of a CAR of the disclosure comprises an antibody fragment. In one embodiment, the CAR of the disclosure comprises an antibody fragment that comprises a scFv.

The disclosure also provides a CAR comprising an extracellular antigen-binding domain, a transmembrane domain and an intracellular signaling domain, wherein the extracellular antigen binding domain binds hK2.

The disclosure also provides a CAR comprising
an extracellular domain comprising an antigen binding domain that binds hK2;
a transmembrane domain; and
an intracellular signaling domain optionally comprising at least one co-stimulatory domain.

In some embodiments, the CAR further comprises a CD8a-hinge region.

In some embodiments, the CAR comprises a CD8a transmembrane region (CD8a-TM) polypeptide and the intracellular signaling domain comprising a co-stimulatory domain comprising a TNF receptor superfamily member 9 (CD137) component and a primary signaling domain comprising a T-cell surface glycoprotein CD3 zeta chain (CD3z) component.

In some embodiments, the CAR comprises
the CD8a-hinge region comprising an amino acid sequence that is at least 90% identical to SEQ ID NO: 25;
the transmembrane domain comprising an amino acid sequence that is at least 90% identical to SEQ ID NO: 26; and/or
the intracellular signaling domain comprising a co-stimulatory domain having an amino acid sequence that is at least 90% identical to SEQ ID NO: 27, and a primary signaling domain having an amino acid sequence that is at least 90% identical to SEQ ID NO: 28.

The disclosure also provides a CAR comprising an extracellular antigen binding domain, a transmembrane domain and an intracellular signaling domain, wherein the extracellular antigen binding domain binds hK2 and comprises:

the LCDR1, the LCDR2 and the LCDR3 of the VL of SEQ ID NO: 138 and the HCDR1, the HCDR2 and the HCDR3 of the VH of SEQ ID NO: 137;

the LCDR1, the LCDR2 and the LCDR3 of the VL of SEQ ID NO: 163 and the HCDR1, the HCDR2 and the HCDR3 of the VH of SEQ ID NO: 161;

the LCDR1, the LCDR2 and the LCDR3 of the VL of SEQ ID NO: 138 and the HCDR1, the HCDR2 and the HCDR3 of the VH of SEQ ID NO: 137;

the LCDR1, the LCDR2 and the LCDR3 of the VL of SEQ ID NO: 165 and the HCDR1, the HCDR2 and the HCDR3 of the VH of SEQ ID NO: 164;

the LCDR1, the LCDR2 and the LCDR3 of the VL of SEQ ID NO: 167 and the HCDR1, the HCDR2 and the HCDR3 of the VH of SEQ ID NO: 166;

the LCDR1, the LCDR2 and the LCDR3 of the VL of SEQ ID NO: 169 and the HCDR1, the HCDR2 and the HCDR3 of the VH of SEQ ID NO: 168;

the LCDR1, the LCDR2 and the LCDR3 of the VL of SEQ ID NO: 205 and the HCDR1, the HCDR2 and the HCDR3 of the VH of SEQ ID NO: 204;

the LCDR1, the LCDR2 and the LCDR3 of the VL of SEQ ID NO: 444 and the HCDR1, the HCDR2 and the HCDR3 of the VH of SEQ ID NO: 166;

the LCDR1, the LCDR2 and the LCDR3 of the VL of SEQ ID NO: 160 and the HCDR1, the HCDR2 and the HCDR3 of the VH of SEQ ID NO: 159;

the LCDR1, the LCDR2 and the LCDR3 of the VL of SEQ ID NO: 140 and the HCDR1, the HCDR2 and the HCDR3 of the VH of SEQ ID NO: 161;

the LCDR1, the LCDR2 and the LCDR3 of the VL of SEQ ID NO: 140 and the HCDR1, the HCDR2 and the HCDR3 of the VH of SEQ ID NO: 139;

the LCDR1, the LCDR2 and the LCDR3 of the VL of SEQ ID NO: 140 and the HCDR1, the HCDR2 and the HCDR3 of the VH of SEQ ID NO: 159;

the LCDR1, the LCDR2 and the LCDR3 of the VL of SEQ ID NO: 1 and the HCDR1, the HCDR2 and the HCDR3 of the VH of SEQ ID NO: 4;

the LCDR1, the LCDR2 and the LCDR3 of the VL of SEQ ID NO: 2 and the HCDR1, the HCDR2 and the HCDR3 of the VH of SEQ ID NO: 4;

the LCDR1, the LCDR2 and the LCDR3 of the VL of SEQ ID NO: 3 and the HCDR1, the HCDR2 and the HCDR3 of the VH of SEQ ID NO: 4;

the LCDR1, the LCDR2 and the LCDR3 of the VL of SEQ ID NO: 1 and the HCDR1, the HCDR2 and the HCDR3 of the VH of SEQ ID NO: 5;

the LCDR1, the LCDR2 and the LCDR3 of the VL of SEQ ID NO: 2 and the HCDR1, the HCDR2 and the HCDR3 of the VH of SEQ ID NO: 5;

the LCDR1, the LCDR2 and the LCDR3 of the VL of SEQ ID NO: 3 and the HCDR1, the HCDR2 and the HCDR3 of the VH of SEQ ID NO: 5;

the LCDR1, the LCDR2 and the LCDR3 of the VL of SEQ ID NO: 1 and the HCDR1, the HCDR2 and the HCDR3 of the VH of SEQ ID NO: 6;

the LCDR1, the LCDR2 and the LCDR3 of the VL of SEQ ID NO: 2 and the HCDR1, the HCDR2 and the HCDR3 of the VH of SEQ ID NO: 6; or the LCDR1, the LCDR2 and the LCDR3 of the VL of SEQ ID NO: 3 and the HCDR1, the HCDR2 and the HCDR3 of the VH of SEQ ID NO: 6.

In a particular embodiment, the disclosure provides a CAR comprising an extracellular antigen binding domain, a transmembrane domain and an intracellular signaling domain, wherein the extracellular antigen binding domain binds hK2 and comprises the LCDR1, the LCDR2 and the LCDR3 of the VL of SEQ ID NO: 163 and the HCDR1, the HCDR2 and the HCDR3 of the VH of SEQ ID NO: 162.

In another particular embodiment, the disclosure provides a CAR comprising an extracellular antigen binding domain, a transmembrane domain and an intracellular signaling domain, wherein the extracellular antigen binding domain binds hK2 and comprises the LCDR1, the LCDR2 and the LCDR3 of the VL of SEQ ID NO: 138 and the HCDR1, the HCDR2 and the HCDR3 of the VH of SEQ ID NO: 137; or the LCDR1, the LCDR2 and the LCDR3 of the VL of SEQ ID NO: 140 and the HCDR1, the HCDR2 and the HCDR3 of the VH of SEQ ID NO: 139.

In some embodiments, the CDRs are defined according to Kabat.

In some embodiments, the CDRs are defined according to Chothia.

In some embodiments, the CDRs are defined according to IMGT.

In some embodiments, the CDRs are defined according to AbM.

The disclosure also provides a CAR comprising an extracellular antigen binding domain that binds hK2, a transmembrane domain and an intracellular signaling domain, wherein the extracellular antigen binding domain that binds hK2 comprises the HCDR1 of SEQ ID NOs: 63, 72, 141, 147, 170, 176, 188, 194, 196, 198, 200, 206 or 216, the HCDR2 of SEQ ID NOs: 64, 65, 73, 142, 148, 171, 177, 183, 189, 195, 197, 199, 201, 207, or 217, the HCDR3 of SEQ ID NOs: 66, 143, 172, 178, 184, 190, 208, or 218, the LCDR1 of SEQ ID NOs: 67, 68, 144, 173, 179, 182, 185 or 191, the LCDR2 of SEQ ID NOs: 69, 70, 145, 174, 180, 186, 192 or 470 and the LCDR3 of SEQ ID NOs: 71, 146, 175, 181, 187, 193, or 209.

The disclosure also provides a CAR comprising an extracellular antigen binding domain that binds hK2, a transmembrane domain and an intracellular signaling domain, wherein the extracellular antigen binding domain that binds hK2 comprises the HCDR1 of SEQ ID NOs: 63, 72, 141, 147, 170, 176, 188, 194, 196, 198, 200, 206 or 216, or conservative substitutions thereof.

The disclosure also provides a CAR comprising an extracellular antigen binding domain that binds hK2, a transmembrane domain and an intracellular signaling domain, wherein the extracellular antigen binding domain that binds hK2 comprises the HCDR2 of SEQ ID NOs: 64, 65, 73, 142, 148, 171, 177, 183, 189, 195, 197, 199, 201, 207, or 217, or conservative substitutions thereof.

The disclosure also provides a CAR comprising an extracellular antigen binding domain that binds hK2, a transmembrane domain and an intracellular signaling domain, wherein the extracellular antigen binding domain that binds hK2 comprises the HCDR3 of SEQ ID NOs: 66, 143, 172, 178, 184, 190, 208, or 218, or conservative substitutions thereof.

The disclosure also provides a CAR comprising an extracellular antigen binding domain that binds hK2, a transmembrane domain and an intracellular signaling domain, wherein the extracellular antigen binding domain that binds hK2 comprises the LCDR1 of SEQ ID NOs: 67, 68, 144, 173, 179, 185 or 191, or conservative substitutions thereof.

The disclosure also provides a CAR comprising an extracellular antigen binding domain that binds hK2, a transmembrane domain and an intracellular signaling domain, wherein the extracellular antigen binding domain that binds hK2 comprises the LCDR2 of SEQ ID NOs: 69, 70, 145, 174, 180, 186, 192 or 470, or conservative substitutions thereof.

The disclosure also provides a CAR comprising an extracellular antigen binding domain that binds hK2, a transmembrane domain and an intracellular signaling domain, wherein the extracellular antigen binding domain that binds hK2 comprises the LCDR3 of SEQ ID NOs: 71, 146, 175, 181, 187, 193, or 209, or conservative substitutions thereof.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 141, 142, 143, 144, 145 and 146, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 170, 171, 172, 173, 174, and 175, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 176, 177, 178, 179, 180 and 181, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 170, 183, 184, 185, 186, and 187, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 188, 189, 190, 191, 192, and 193, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 206, 207, 208, 182, 470, and 209, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 147, 148, 143, 144, 145 and 146, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 194, 195, 172, 173, 174, and 175, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 196, 197, 178, 179, 180, and 181, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 198, 199, 184, 185, 186, and 187, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 200, 201, 190, 191, 192, 193, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 216, 217, 218, 182, 470, and 209, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 63, 65, 66, 67, 69 and 71, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 72, 73, 66, 67, 69 and 71, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 63, 64, 66, 67, 69 and 71, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 63, 65, 66, 68, 70 and 71, respectively.

The disclosure also provides a CAR comprising an extracellular antigen binding domain that binds hK2, a transmembrane domain and an intracellular signaling domain, wherein the extracellular antigen binding domain that binds hK2 comprises the HCDR1, the HCDR2, the HCDR3, the LCDR1, the LCDR2 and the LCDR3 of SEQ ID NOs: 72, 73, 66, 68, 70 and 71, respectively.

In some embodiments, the extracellular antigen binding domain that binds hK2 comprises the VL of SEQ ID NOs: 1, 2, 3, 138, 140, 160, 163, 165, 167, 169, or 205.

In some embodiments, the extracellular antigen binding domain that binds hK2 comprises the VH of SEQ ID NOs: 4, 5, 6, 137, 139, 159, 161, 162, 164, 166, 168, or 204.

In some embodiments, the extracellular antigen binding domain that binds hK2 comprises the VL of SEQ ID NOs: 1, 2, 3, 138, 140, 160, 163, 165, 167, 169, 205, or 444 and the VH of SEQ ID NOs: 4, 5, 6, 137, 139, 159, 161, 162, 164, 166, 168, or 204.

In some embodiments, the extracellular antigen binding domain that binds hK2 comprises
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 4 and the VL of SEQ ID NO: 140;
the VH of SEQ ID NO: 4 and the VL of SEQ ID NO: 160;
the VH of SEQ ID NO: 5 and the VL of SEQ ID NO: 1;
the VH of SEQ ID NO: 5 and the VL of SEQ ID NO: 3;
the VH of SEQ ID NO: 5 and the VL of SEQ ID NO: 140;
the VH of SEQ ID NO: 5 and the VL of SEQ ID NO: 160;
the VH of SEQ ID NO: 6 and the VL of SEQ ID NO: 1;
the VH of SEQ ID NO: 6 and the VL of SEQ ID NO: 2;
the VH of SEQ ID NO: 6 and the VL of SEQ ID NO: 3;
the VH of SEQ ID NO: 6 and the VL of SEQ ID NO: 140;
the VH of SEQ ID NO: 6 and the VL of SEQ ID NO: 160;
the VH of SEQ ID NO: 139 and the VL of SEQ ID NO: 1;
the VH of SEQ ID NO: 139 and the VL of SEQ ID NO: 2;
the VH of SEQ ID NO: 139 and the VL of SEQ ID NO: 3;
the VH of SEQ ID NO: 139 and the VL of SEQ ID NO: 140;
the VH of SEQ ID NO: 139 and the VL of SEQ ID NO: 160;
the VH of SEQ ID NO: 159 and the VL of SEQ ID NO: 1;
the VH of SEQ ID NO: 159 and the VL of SEQ ID NO: 2;
the VH of SEQ ID NO: 159 and the VL of SEQ ID NO: 3;
the VH of SEQ ID NO: 159 and the VL of SEQ ID NO: 140;
the VH of SEQ ID NO: 159 and the VL of SEQ ID NO: 160;
the VH of SEQ ID NO: 161 and the VL of SEQ ID NO: 1;
the VH of SEQ ID NO: 159 and the VL of SEQ ID NO: 2;
the VH of SEQ ID NO: 161 and the VL of SEQ ID NO: 3;
the VH of SEQ ID NO: 161 and the VL of SEQ ID NO: 140;
or
the VH of SEQ ID NO: 161 and the VL of SEQ ID NO: 160

In some embodiments, the extracellular antigen-binding domain comprises the VL comprising the amino acid sequence that is at least 85%, at least 90%, at least 95%, at least 98% or at least 99% identical with the polypeptide of SEQ ID NO: 138 and the VH comprising the amino acid sequence that is at least 85%, at least 90%, at least 95%, at least 98% or at least 99% identical with the polypeptide of SEQ ID NO: 137.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 163 and the VH comprising the amino acid sequence that is at least 85%, at least 90%, at least 95%, at least 98% or at least 99% identical with the polypeptide of SEQ ID NO: 162.

In some embodiments, the extracellular antigen-binding domain comprises the VL of SEQ ID NO: 163 and the VH comprising the amino acid sequence that is at least 85%, at least 90%, at least 95%, at least 98% or at least 99% identical with the polypeptide of SEQ ID NO: 162.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 163 and the VH of SEQ ID NO: 162.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 165 and the VH comprising the amino acid sequence that is at least 85%, at least 90%, at least 95%, at least 98% or at least 99% identical with the polypeptide of SEQ ID NO: 164.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 167 and the VH comprising the amino acid sequence that is at least 85%, at least 90%, at least 95%, at least 98% or at least 99% identical with the polypeptide of SEQ ID NO: 166.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 168 and the VH comprising the amino acid sequence that is at least 85%, at least 90%, at least 95%, at least 98% or at least 99% identical with the polypeptide of SEQ ID NO: 169.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 204 and the VH comprising the amino acid sequence that is at least 85%, at least 90%, at least 95%, at least 98% or at least 99% identical with the polypeptide of SEQ ID NO: 205.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 160 and the VH comprising the amino acid sequence that is at least 85%, at least 90%, at least 95%, at least 98% or at least 99% identical with the polypeptide of SEQ ID NO: 159.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 140 and the VH comprising the amino acid sequence that is at least 85%, at least 90%, at least 95%, at least 98% or at least 99% identical with the polypeptide of SEQ ID NO: 161.

In some embodiments, the extracellular antigen-binding domain comprises the VL comprising the amino acid sequence that is at least 85%, at least 90% at least 95%, at least 98% or at least 99% identical with the polypeptide of SEQ ID NO: 140 and the VH comprising the amino acid sequence that is at least 85%, at least 90%, at least 95%, at least 98% or at least 99% identical with the polypeptide of SEQ ID NO: 139.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 140 and the VH comprising the amino acid sequence that is at least 85%, at least 90%, at least 95%, at least 98% or at least 99% identical with the polypeptide of SEQ ID NO: 159.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 1 and the VH comprising the amino acid sequence that is at least 85%, at least 90%, at least 95%, at least 98% or at least 99% identical with the polypeptide of SEQ ID NO: 4.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 1 and the VH comprising the amino acid sequence that is at least 50%, at least 85%, at least 90%, at least 95%, at least 98% or at least 99% identical with the polypeptide of SEQ ID NO: 5.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 1 and the VH comprising the amino acid sequence that is at least 80%, at least 85%, at least 90%, at least 95%, at least 98% or at least 99% identical with the polypeptide of SEQ ID NO: 6.

In some embodiments, the extracellular antigen-binding domain comprises the VL comprising the amino acid sequence that is at least 850, at least 90%, at least 95%, at least 98% or at least 99% identical with the polypeptide of SEQ ID NO: 2 and the VH comprising the amino acid sequence that is at least 85%, at least 90%, at least 95%, at least 98% or at least 99% identical with the polypeptide of SEQ ID NO: 4.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 2 and the VH comprising the amino acid sequence that is at least 85%, at least 90%, at least 95%, at least 98% or at least 99% identical with the polypeptide of SEQ ID NO: 5.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 2 and the VH comprising the amino acid sequence that is at least 85%, at least 90%, at least 95%, at least 98% or at least 99% identical with the polypeptide of SEQ ID NO: 6.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 3 and the VH comprising the amino acid sequence that is at least 85%, at least 90%, at least 95%, at least 98% or at least 99% identical with the polypeptide of SEQ ID NO: 4.

In some embodiments, the extracellular antigen-binding domain comprises the VL comprising the amino acid sequence that is at least 85%, at least 90%, at least 95%, at least 98% or at least 99% identical with the polypeptide of SEQ ID NO: 3 and the VH comprising the amino acid sequence that is at least 85%, at least 90%, at least 95%, at least 98% or at least 99% identical with the polypeptide of SEQ ID NO: 5.

In some embodiments, the extracellular antigen-binding domain comprises the VL comprising the amino acid sequence that is at 85%, at least 90%, at least 95%, at least 98% or at least 99% identical with the polypeptide of SEQ ID NO: 3 and the VH comprising the amino acid sequence that is at least 85%, at least 90%, at least 95%, at least 98% or at least 99% identical with the polypeptide of SEQ ID NO: 6.

In a particular embodiment, the CAR comprises an extracellular antigen binding domain comprising a VL comprising the amino acid sequence of SEQ ID NO: 138 or SEQ ID NO: 140 and a VH comprising the amino acid sequence of SEQ ID NO: 137 or SEQ ID NO: 139.

In some embodiments, the extracellular antigen binding domain that binds hK2 comprises a scFv. In some embodiments, the scFv comprises a linker polypeptide between the VL and the VH.

In some embodiments, the linker polypeptide comprises the amino acid sequence of SEQ ID NO: 7. In some embodiments, the linker polypeptide comprises an amino acid sequence having at least 50%, at least 55%, at least 60%, at least 65%, at least 70%, at least 75%, at least 80%, at least 85%, at least 90%, at least 95%, at least 98% or at least 99% sequence identity with SEQ ID NO: 7.

In some embodiments, the extracellular antigen binding domain that binds hK2 is a scFv which comprises an amino acid sequence selected from the group consisting of SEQ ID NOs: 29, 30, 31, 32, 33, 34, 35, 36, 37, 38, 39, 40, 41, 42, 43, 44, 149, 150, 151, 152, 410, 411, 412, 413, 414, 415, 416, 417, 418, 419, 420, 421, 422, 423, 424, or 425.

In some embodiments, the extracellular antigen binding domain that binds hK2 is a scFv which comprises an amino acid sequence SEQ ID NO: 29.

In some embodiments, the extracellular antigen binding domain that binds hK2 is a scFv which comprises an amino acid sequence SEQ ID NO: 30.

In some embodiments, the extracellular antigen binding domain that binds hK2 is a scFv which comprises an amino acid sequence SEQ ID NO: 31.

In some embodiments, the extracellular antigen binding domain that binds hK2 is a scFv which comprises an amino acid sequence SEQ ID NO: 32.

In some embodiments, the extracellular antigen binding domain that binds hK2 is a scFv which comprises an amino acid sequence SEQ ID NO: 33.

In some embodiments, the extracellular antigen binding domain that binds hK2 is a scFv which comprises an amino acid sequence SEQ ID NO: 34.

In some embodiments, the extracellular antigen binding domain that binds hK2 is a scFv which comprises an amino acid sequence SEQ ID NO: 34.

In some embodiments, the extracellular antigen binding domain that binds hK2 is a scFv which comprises an amino acid sequence SEQ ID NO: 36.

In some embodiments, the extracellular antigen binding domain that binds hK2 is a scFv which comprises an amino acid sequence SEQ ID NO: 37.

In some embodiments, the extracellular antigen binding domain that binds hK2 is a scFv which comprises an amino acid sequence SEQ ID NO: 38.

In some embodiments, the extracellular antigen binding domain that binds hK2 is a scFv which comprises an amino acid sequence SEQ ID NO: 39.

In some embodiments, the extracellular antigen binding domain that binds hK2 is a scFv which comprises an amino acid sequence SEQ ID NO: 40.

In some embodiments, the extracellular antigen binding domain that binds hK2 is a scFv which comprises an amino acid sequence SEQ ID NO: 41.

In some embodiments, the extracellular antigen binding domain that binds hK2 is a scFv which comprises an amino acid sequence SEQ ID NO: 42.

In some embodiments, the extracellular antigen binding domain that binds hK2 is a scFv which comprises an amino acid sequence SEQ ID NO: 43.

In some embodiments, the extracellular antigen binding domain that binds hK2 is a scFv which comprises an amino acid sequence SEQ ID NO: 44.

In some embodiments, the extracellular antigen binding domain that binds hK2 is a scFv which comprises an amino acid sequence SEQ ID NO: 149.

In some embodiments, the extracellular antigen binding domain that binds hK2 is a scFv which comprises an amino acid sequence SEQ ID NO: 150.

In some embodiments, the extracellular antigen binding domain that binds hK2 is a scFv which comprises an amino acid sequence SEQ ID NO: 151.

In some embodiments, the extracellular antigen binding domain that binds hK2 is a scFv which comprises an amino acid sequence SEQ ID NO: 152.

In some embodiments, the extracellular antigen binding domain that binds hK2 is a scFv which comprises an amino acid sequence SEQ ID NO: 410.

In some embodiments, the extracellular antigen binding domain that binds hK2 is a scFv which comprises an amino acid sequence SEQ ID NO: 411.

In some embodiments, the extracellular antigen binding domain that binds hK2 is a scFv which comprises an amino acid sequence SEQ ID NO: 412.

In some embodiments, the extracellular antigen binding domain that binds hK2 is a scFv which comprises an amino acid sequence SEQ ID NO: 413.

In some embodiments, the extracellular antigen binding domain that binds hK2 is a scFv which comprises an amino acid sequence SEQ ID NO: 414.

In some embodiments, the extracellular antigen binding domain that binds hK2 is a scFv which comprises an amino acid sequence SEQ ID NO: 415.

In some embodiments, the extracellular antigen binding domain that binds hK2 is a scFv which comprises an amino acid sequence SEQ ID NO: 416.

In some embodiments, the extracellular antigen binding domain that binds hK2 is a scFv which comprises an amino acid sequence SEQ ID NO: 417.

In some embodiments, the extracellular antigen binding domain that binds hK2 is a scFv which comprises an amino acid sequence SEQ ID NO: 418.

In some embodiments, the extracellular antigen binding domain that binds hK2 is a scFv which comprises an amino acid sequence SEQ ID NO: 419.

In some embodiments, the extracellular antigen binding domain that binds hK2 is a scFv which comprises an amino acid sequence SEQ ID NO: 420.

In some embodiments, the extracellular antigen binding domain that binds hK2 is a scFv which comprises an amino acid sequence SEQ ID NO: 421.

In some embodiments, the extracellular antigen binding domain that binds hK2 is a scFv which comprises an amino acid sequence SEQ ID NO: 422.

In some embodiments, the extracellular antigen binding domain that binds hK2 is a scFv which comprises an amino acid sequence SEQ ID NO: 423.

In some embodiments, the extracellular antigen binding domain that binds hK2 is a scFv which comprises an amino acid sequence SEQ ID NO: 424.

In some embodiments, the extracellular antigen binding domain that binds hK2 is a scFv which comprises an amino acid sequence SEQ ID NO: 425.

In a some embodiments, the extracellular antigen binding domain that binds hK2 is a scFv which comprises an amino acid sequence which is at least 80% (e.g. at least 90%, at least 95%, at least 98% or at least 99%) identical to the amino acid sequence SEQ ID NO: 416 or SEQ ID NO: 417.

In a particular embodiment the extracellular antigen binding domain that binds hK2 is a scFv which comprises an amino acid sequence which is identical to the amino acid sequence SEQ ID NO: 416 or SEQ ID NO: 417

In some embodiments, the CAR comprises an extracellular antigen binding domain that binds hK2 comprising a scFv which comprises an amino acid sequence which is at least 80% (e.g. at least 90%, at least 95%, at least 98% or at least 99%) identical to the amino acid sequence SEQ ID NO: 149, SEQ ID NO: 150, SEQ ID NO: 151 or SEQ ID NO: 152

In a particular embodiment, the CAR comprises an extracellular antigen binding domain that binds hK2 comprising a scFv which comprises an amino acid sequence which is identical to the amino acid sequence SEQ ID NO: 149, SEQ ID NO: 150, SEQ ID NO: 151 or SEQ ID NO: 152

In some embodiments, the scFv comprises the amino acid sequence that is at least 80%, at least 85%, at least 90%, at In some embodiments, the scFv comprises the amino acid sequence that is at least 80%, at least 85%, at least 90%, at least 95%, at least 98% or at least 99% identical to the amino acid sequence of SEQ ID NO: 8.

In some embodiments, the scFv comprises the amino acid sequence that is at least 80%, at least 85%, at least 90%, at least 95%, at least 98% or at least 99% identical to the amino acid sequence of SEQ ID NO: 9.

In some embodiments, the scFv comprises the amino acid sequence that is at least 80%, at least 85%, at least 90%, at least 95%, at least 98% or at least 99% identical to the amino acid sequence of SEQ ID NO: 10.

In some embodiments, the scFv comprises the amino acid sequence that is at least 80%, at least 85%, at least 90%, at least 95%, at least 98% or at least 99% identical to the amino acid sequence of SEQ ID NO: 11.

In some embodiments, the scFv comprises the amino acid sequence that is at least 80%, at least 85%, at least 90%, at least 95%, at least 98% or at least 99% identical to the amino acid sequence of SEQ ID NO: 12.

In some embodiments, the scFv comprises the amino acid sequence that is at least 80%, at least 85%, at least 90%, at least 95%, at least 98% or at least 99% identical to the amino acid sequence of SEQ ID NO: 13.

In some embodiments, the scFv comprises the amino acid sequence that is at least 80%, at least 85%, at least 90%, at least 95%, at least 98% or at least 99% identical to the amino acid sequence of SEQ ID NO: 14.

In some embodiments, the scFv comprises the amino acid sequence that is at least 80%, at least 85%, at least 90%, at least 95%, at least 98% or at least 99% identical to the amino acid sequence of SEQ ID NO: 15.

In some embodiments, the scFv comprises the amino acid sequence that is at least 80%, at least 85%, at least 90%, at least 95%, at least 98% or at least 99% identical to the amino acid sequence of SEQ ID NO: 16.

In some embodiments, the scFv comprises the amino acid sequence that is at least 80%, at least 85%, at least 90%, at least 95%, at least 98% or at least 99% identical to the amino acid sequence of SEQ ID NO: 17.

In some embodiments, the scFv comprises the amino acid sequence that is at least 80%, at least 85%, at least 90%, at least 95%, at least 98% or at least 99% identical to the amino acid sequence of SEQ ID NO: 18.

In some embodiments, the scFv comprises the amino acid sequence that is at least 80%, at least 85%, at least 90%, at least 95%, at least 98% or at least 99% identical to the amino acid sequence of SEQ ID NO: 19.

In some embodiments, the scFv comprises the amino acid sequence that is at least 80%, at least 85%, at least 90%, at least 95%, at least 98% or at least 99% identical to the amino acid sequence of SEQ ID NO: 20.

In some embodiments, the scFv comprises the amino acid sequence that is at least 80%, at least 85%, at least 90%, at least 95%, at least 98% or at least 99% identical to the amino acid sequence of SEQ ID NO: 21.

In some embodiments, the scFv comprises the amino acid sequence that is at least 80%, at least 85% at least 90%, at least 95%, at least 98% or at least 99% identical to the amino acid sequence of SEQ ID NO: 22.

In some embodiments, the scFv comprises the amino acid sequence that is at least 80%, at least 85%, at least 90%, at least 95%, at least 98% or at least 99% identical to the amino acid sequence of SEQ ID NO: 23.

In some embodiments, the scFv comprises the amino acid sequence that is at least 80%, at least 85%, at least 90%, at least 95%, at least 98% or at least 99% identical to the amino acid sequence of SEQ ID NO: 133.

In some embodiments, the scFv comprises the amino acid sequence that is at least 80%, at least 85% at least 90%, at least 95%, at least 98% or at least 99% identical to the amino acid sequence of SEQ ID NO: 134.

In some embodiments, the scFv comprises the amino acid sequence that is at least 80%, at least 85%, at least 90%, at least 95%, at least 98% or at least 99% identical to the amino acid sequence of SEQ ID NO: 135.

In some embodiments, the scFv comprises the amino acid sequence that is at least 80%, at least 85%, at least 90%, at least 95%, at least 98% or at least 99% identical to the amino acid sequence of SEQ ID NO: 136.

In some embodiments, the scFv comprises the amino acid sequence that is at least 80%, at least 85%, at least 90%, at least 95%, at least 98% or at least 99% identical to the amino acid sequence of SEQ ID NO: 318.

In some embodiments, the scFv comprises the amino acid sequence that is at least 80%, at least 85%, at least 90%, at least 95%, at least 98% or at least 99% identical to the amino acid sequence of SEQ ID NO: 319.

In some embodiments, the scFv comprises the amino acid sequence that is at least 80%, at least 85%, at least 90%, at least 95%, at least 98% or at least 99% identical to the amino acid sequence of SEQ ID NO: 320.

In some embodiments, the scFv comprises the amino acid sequence that is at least 80%, at least 85%, at least 90%, at least 95%, at least 98% or at least 99% identical to the amino acid sequence of SEQ ID NO: 321.

In some embodiments, the scFv comprises the amino acid sequence that is at least 80%, at least 85%, at least 90%, at least 95%, at least 98% or at least 99% identical to the amino acid sequence of SEQ ID NO: 322.

In some embodiments, the scFv comprises the amino acid sequence that is at least 80%, at least 85%, at least 90%, at least 95%, at least 98% or at least 99% identical to the amino acid sequence of SEQ ID NO: 323.

In some embodiments, the scFv comprises the amino acid sequence that is at least 80%, at least 85%, at least 90%, at least 95%, at least 98% or at least 99% identical to the amino acid sequence of SEQ ID NO: 404.

In some embodiments, the scFv comprises the amino acid sequence that is at least 80%, at least 85%, at least 90%, at least 95%, at least 98% or at least 99% identical to the amino acid sequence of SEQ ID NO: 405.

In some embodiments, the scFv comprises the amino acid sequence that is at least 80%, at least 85%, at least 90%, at least 95%, at least 98% or at least 99% identical to the amino acid sequence of SEQ ID NO: 322.

In some embodiments, the scFv comprises the amino acid sequence that is at least 80%, at least 85%, at least 90%, at least 95%, at least 98% or at least 99% identical to the amino acid sequence of SEQ ID NO: 323.

In some embodiments, the scFv comprises the amino acid sequence that is at least 80%, at least 85%, at least 90%, at least 95%, at least 98% or at least 99% identical to the amino acid sequence of SEQ ID NO: 404.

In some embodiments, the scFv comprises the amino acid sequence that is at least 80%, at least 85%, at least 90%, at least 95%, at least 98% or at least 99% identical to the amino acid sequence of SEQ ID NO: 405.

In some embodiments, the scFv comprises the amino acid sequence that is at least 80%, at least 85%, at least 90%, at least 95%, at least 98% or at least 99% identical to the amino acid sequence of SEQ ID NO: 406.

In some embodiments, the scFv comprises the amino acid sequence that is at least 80%, at least 85%, at least 90%, at least 95%, at least 98% or at least 99% identical to the amino acid sequence of SEQ ID NO: 407.

In some embodiments, the scFv comprises the amino acid sequence that is at least 80%, at least 85%, at least 90%, at least 95%, at least 98% or at least 99% identical to the amino acid sequence of SEQ ID NO: 408.

In some embodiments, the scFv comprises the amino acid sequence that is at least 80%, at least 85%, at least 90%, at least 95%, at least 98% or at least 99% identical to the amino acid sequence of SEQ ID NO: 409.

In some embodiments, the scFv comprises the amino acid sequence that is at least 80%, at least 85%, at least 90%, at least 95%, at least 98% or at least 99% identical to the amino acid sequence of SEQ ID NO: 324.

In some embodiments, the scFv comprises the amino acid sequence that is at least 80%, at least 85%, at least 90%, at least 95%, at least 98% or at least 99% identical to the amino acid sequence of SEQ ID NO: 325.

In some embodiments, the scFv comprises the amino acid sequence that is at least 80%, at least 85%, at least 90%, at least 95%, at least 98% or at least 99% identical to the amino acid sequence of SEQ ID NO: 308.

In some embodiments, the scFv comprises the amino acid sequence that is at least 80%, at least 85%, at least 90%, at least 95%, at least 98% or at least 99% identical to the amino acid sequence of SEQ ID NO: 316.

In some embodiments, the scFv comprises an amino acid sequence which is at least 80% (e.g. at least 90%, at least 95%, at least 98% or at least 99%) identical to the amino acid sequence of SEQ ID NO: 404.

In some embodiments, the scFv comprises an amino acid sequence which is at least 80% (e.g. at least 90%, at least 95%, at least 98% or at least 99%) identical to the amino acid sequence of SEQ ID NO: 405.

In some embodiments, the scFv comprises an amino acid sequence which is identical to the amino acid sequence of SEQ ID NO: 404 or SEQ ID NO: 405.

In some embodiments, the scFv comprises an amino acid sequence which is at least 80% (e.g. at least 90%, at least 95%, at least 98% or at least 99%) identical to the amino acid sequence of SEQ ID NO: 133, SEQ ID NO: 134, SEQ ID NO: 135 or SEQ ID NO: 136.

In some embodiments, the scFv comprises an amino acid sequence which is at least 80% (e.g. at least 90%, at least 95%, at least 98% or at least 99%) identical to the amino acid sequence of SEQ ID NO: 134.

In some embodiments, the scFv comprises an amino acid sequence which is at least 80% (e.g. at least 90%, at least 95%, at least 98% or at least 99%) identical to the amino acid sequence of SEQ ID NO: 135.

In some embodiments, the scFv comprises an amino acid sequence which is at least 80% (e.g. at least 90%, at least 95%, at least 98% or at least 99%) identical to the amino acid sequence of SEQ ID NO: 136.

In a particular embodiment, the scFv comprises an amino acid sequence which is identical to the amino acid sequence of SEQ ID NO: 133, SEQ ID NO: 134, SEQ ID NO: 135 or SEQ ID NO: 136.

In some embodiment, the extracellular antigen binding domain that binds hK2 comprises a signal polypeptide. In some embodiments, the signal sequence comprises an amino acid sequence of SEQ ID NO: 24.

The disclosure also provides a CAR comprising an extracellular antigen binding domain that binds hK2, a transmembrane domain and an intracellular signaling domain, wherein the extracellular antigen binding domain that binds hK2 comprises the amino acid sequence selected from the group consisting of SEQ ID NOs: 29, 30, 31, 32, 33, 34, 35, 36, 37, 38, 39, 40, 41, 42, 43, 44, 149, 150, 151, 152, 410, 411, 412, 413, 414, 415, 416, 417, 418, 419, 420, 421, 422, 423, 424, or 425.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 33.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 33.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 34.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 34.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 35.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 35.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 36.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 36.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 37.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 37.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 38.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 38.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 39.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 39.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 40.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 40.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 41.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 41.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 42.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 42.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 43.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 43.

The disclosure also provides a CAR comprising an extracellular antigen binding domain that binds hK2, a transmembrane domain and an intracellular signaling domain, wherein the extracellular antigen binding domain that binds hK2 comprises the amino acid sequence of SEQ ID NO: 44.

In one embodiment, the extracellular antigen binding domain comprises an amino acid sequence that is at least 50%, at least 55%, at least 60%, at least 65%, at least 70%, at least 75%, at least 80%, at least 85%, at least 90%, at least 95%, at least 98% or at least 99% identical with the amino acid sequence of SEQ ID NO: 44.

In some embodiments, the intracellular signaling domain comprises a polypeptide component selected from the group consisting of a TNF receptor superfamily member 9 (CD137) component, a T-cell surface glycoprotein CD3 zeta chain (CD3z) component, a cluster of differentiation (CD27) component, a cluster of differentiation superfamily member (such as, e.g., CD28 or inducible T-cell co-stimulator (ICOS) component, and a combination thereof.

In some embodiments, the CD137 component comprises an amino acid sequence of SEQ ID NO: 27. In some embodiments, the CD137 component comprises an amino acid sequence that is at least 80%, at least 85%, at least 90%, at least 95%, at least 98 or at least 99% identical to the amino acid sequence of SEQ ID NO: 27.

In some embodiments, the CD3z component comprises an amino acid sequence of SEQ ID NO: 28. In some embodiments, the CD3z component comprises an amino acid sequence that is at least 80%, at least 85%, at least 90%, at least 95%, at least 98 or at least 99% identical to the amino acid sequence of SEQ ID NO: 28.

In some embodiments, the intracellular signaling domain comprises an amino acid sequence of SEQ ID NO: 45. In some embodiments, the intracellular signaling domain comprises an amino acid sequence that is at least 80%, at least 85%, at least 90%, at least 95%, at least 98 or at least 99% identical to the amino acid sequence of SEQ ID NO: 45.

```
                                      SEQ ID NO: 45
KRGRKKLLYIFKQPFMRPVQTTQEEDGCSCRFPEEEEGGCELRVKFSRSA

DAPAYKQGQNQLYNELNLGRREEYDVLDKRRGRDPEMGGKPRRKNPQEGL

YNELQKDKMAEAYSEIGMKGERRRGKGHDGLYQGUSTATKDTYDAMMQAL

PPR
```

In some embodiments, the transmembrane domain comprises a CD8a transmembrane region (CD8a-TM) polypeptide. In some embodiments, the CD8a-TM polypeptide comprises an amino acid sequence of SEQ ID NO: 26. (IYIWAPLAGTCGVLLLSLVITLYC; SEQ ID NO: 26).

In some embodiments, the CD8a-TM polypeptide comprises an amino acid sequence that is least 80%, at least 85%, at least 90%, at least 95%, at least 98% or at least 99% identical to the amino acid sequence of SEQ ID NO: 26.

In some embodiments, the transmembrane domain comprises at least the transmembrane region(s) of) the α, β or ζ chain of the T-cell receptor, CD28, CD3 epsilon, CD45, CD4, CD5, CD8, CD8a, CD9, CD16, CD22, CD33, CD37, CD40, CD64, CD80, CD86, CD134, CD137, CD154. In some embodiments, the transmembrane domain comprises at least the transmembrane domain of ζ, η or FcεR1γ and -β, MB1 (Igα.), B29 or CD3-γ, ζ, or η. In some embodiments, the transmembrane domain is synthetic, e.g., comprising predominantly hydrophobic residues such as leucine and valine, a triplet of phenylalanine, or tryptophan.

In some embodiments, the CAR further comprises a hinge region linking the transmembrane domain to the extracellular antigen binding domain that binds hK2. In some embodiments, the hinge region is a CD8a-hinge region. In some embodiments, CD8a-hinge region comprises an amino acid sequence of (TSTPAPRPPTPAPTIASQPLSLRPEACRPAAGGAVHTRGLDFACD; SEQ ID NO: 25). SEQ ID NO: 25

In some embodiments, the CD8a-hinge region comprises an amino acid sequence that is at least 50%, at least 55%, at least 60%, at least 65%, at least 70%, at least 75%, at least 80%, at least 85%, at least 90%, at least 95%, at least 98% or at least 99% identical to the amino acid sequence of SEQ ID NO: 25. In some embodiments, the hinge region comprises the amino acid sequence EPKSCDKTHTCPPCP (SEQ ID NO: 126), or comprises an amino acid sequence having at least 50%, at least 55%, at least 60%, at least 65%, at least 70%, at least 75%, at least 80%, at least 85%, at least 90%, at least 95%, at least 98% or at least 99% amino acid sequence identity with EPKSCDKTHTCPPCP (SEQ ID NO: 126). In some embodiments, the hinge region comprises the sequence ERKCCVECPPCP (SEQ ID NO: 127) or comprises an amino acid sequence having at least 50%, at least 55%, at least 60%, at least 65%, at least 70% at least 75%, at least 80%, at least 85%, at least 90%, at least 95%, at least 98% or at least 99% sequence identity with ERKCCVECPPCP (SEQ ID NO: 127). In some embodiments, the hinge region comprises the sequence ELKTPLGDTTHTCPRCP(EPKSCDTPPPCPRCP)$_3$, (SEQ ID NO: 128) or comprises an amino acid sequence having at least 50%, at least 55%, at least 60%, at least 65%, at least 70%, at least 75%, at least 80%, at least 85%, at least 90%, at least 95%, at least 98% or at least 99% sequence identity with ELKTPLGDTTHTCPRCP(EPKSCDTPPPCPRCP)$_3$ (SEQ ID NO: 128). In some embodiments, the hinge region comprises the sequence ESKYGPPCPSCP (SEQ ID NO: 129), or comprises an amino acid sequence having at least 50%, at least 55%, at least 60%, at least 65%, at least 70%, at least 75%, at least 80%, at least 85%, at least 90%, at least 95%, at least 98% or at least 99% sequence identity with ESKYGPPCPSCP (SEQ ID NO: 129).

The disclosure also provides a CAR comprising the amino acid sequence of SEQ ID NOs: 46, 47, 48, 49, 50, 51, 52, 53, 54, 55, 56, 57, 58, 59, 60, 61, 153, 154, 155, 156, 426, 427, 428, 429, 430, 431, 432, 433, 434, 435, 435, 436, 437, 438, 439, 440, or 441.

The disclosure also provides a CAR comprising the amino acid sequence of SEQ ID NO: 46.

The disclosure also provides a CAR comprising the amino acid sequence that is at least 80%, at least 85%, at least 90%, at least 95%, at least 98% or at least 99% identical to the amino acid sequence of SEQ ID NO: 46.

The disclosure also provides a CAR comprising the amino acid sequence of SEQ ID NO: 47.

The disclosure also provides a CAR comprising the amino acid sequence that is at least 80% at least 85%, at least 90%, at least 95%, at least 98% or at least 99% identical to the amino acid sequence of SEQ ID NO: 47.

The disclosure also provides a CAR comprising the amino acid sequence of SEQ ID NO: 48.

The disclosure also provides a CAR comprising the amino acid sequence that is at least 80%, at least 85%, at least 90%, at least 95%, at least 98% or at least 99% identical to the amino acid sequence of SEQ ID NO: 48.

The disclosure also provides a CAR comprising the amino acid sequence of SEQ ID NO: 49.

The disclosure also provides a CAR comprising the amino acid sequence that is at least 80%, at least 85%, at least 90%, at least 95%, at least 98% or at least 99% identical to the amino acid sequence of SEQ ID NO: 49.

The disclosure also provides a CAR comprising the amino acid sequence of SEQ ID NO: 50.

The disclosure also provides a CAR comprising the amino acid sequence that is at least 80%, at least 85%, at least 90%, at least 95%, at least 98% or at least 99% identical to the amino acid sequence of SEQ ID NO: 51.

The disclosure also provides a CAR comprising the amino acid sequence of SEQ ID NO: 52.

The disclosure also provides a CAR comprising the amino acid sequence that is at least 80%, at least 85%, at least 90%, at least 95%, at least 98% or at least 99% identical to the amino acid sequence of SEQ ID NO: 52.

The disclosure also provides a CAR comprising the amino acid sequence of SEQ ID NO: 53.

The disclosure also provides a CAR comprising the amino acid sequence that is at least 80% at least 85%, at least 90%, at least 95%, at least 98% or at least 99% identical to the amino acid sequence of SEQ ID NO: 53.

The disclosure also provides a CAR comprising the amino acid sequence of SEQ ID NO: 54.

The disclosure also provides a CAR comprising the amino acid sequence that is at least 80%, at least 85%, at least 90%, at least 95%, at least 98% or at least 99% identical to the amino acid sequence of SEQ ID NO: 54.

The disclosure also provides a CAR comprising the amino acid sequence of SEQ ID NO: 55.

The disclosure also provides a CAR comprising the amino acid sequence that is at least 80%, at least 85%, at least 90%, at least 95%, at least 98% or at least 99% identical to the amino acid sequence of SEQ ID NO: 55.

The disclosure also provides a CAR comprising the amino acid sequence of SEQ ID NO: 56.

The disclosure also provides a CAR comprising the amino acid sequence that is at least 80% at least 85%, at least 90%, at least 95%, at least 98% or at least 99% identical to the amino acid sequence of SEQ ID NO: 56.

The disclosure also provides a CAR comprising the amino acid sequence of SEQ ID NO: 57.

The disclosure also provides a CAR comprising the amino acid sequence that is at least 80%, at least 85%, at least 90%, at least 95%, at least 98% or at least 99% identical to the amino acid sequence of SEQ ID NO: 57.

The disclosure also provides a CAR comprising the amino acid sequence of SEQ ID NO: 58.

The disclosure also provides a CAR comprising the amino acid sequence that is at least 80%, at least 85%, at least 90%, at least 95%, at least 98% or at least 99% identical to the amino acid sequence of SEQ ID NO: 58.

The disclosure also provides a CAR comprising the amino acid sequence of SEQ ID NO: 59.

The disclosure also provides a CAR comprising the amino acid sequence that is at least 80%, at least 85%, at least 90%, at least 95%, at least 98% or at least 99% identical to the amino acid sequence of SEQ ID NO: 59.

The disclosure also provides a CAR comprising the amino acid sequence of SEQ ID NO: 60.

The disclosure also provides a CAR comprising the amino acid sequence that is at least 80%, at least 85%, at least 90%, at least 95%, at least 98% or at least 99% identical to the amino acid sequence of SEQ ID NO: 60.

The disclosure also provides a CAR comprising the amino acid sequence of SEQ ID NO: 61.

The disclosure also provides a CAR comprising the amino acid sequence that is at least 80%, at least 85%, at least 90%, at least 95%, at least 98% or at least 99% identical to the amino acid sequence of SEQ ID NO: 61.

The disclosure also provides a CAR comprising the amino acid sequence of SEQ ID NO: 153.

The disclosure also provides a CAR comprising the amino acid sequence that is at least 80%, at least 85%, at least 90%, at least 95%, at least 98% or at least 99% identical to the amino acid sequence of SEQ ID NO: 153.

The disclosure also provides a CAR comprising the amino acid sequence of SEQ ID NO: 154.

The disclosure also provides a CAR comprising the amino acid sequence that is at least 80%, at least 85%, at least 90%, at least 95%, at least 98% or at least 99% identical to the amino acid sequence of SEQ ID NO: 154.

The disclosure also provides a CAR comprising the amino acid sequence of SEQ ID NO: 155.

The disclosure also provides a CAR comprising the amino acid sequence that is at least 80%, at least 85%, at least 90%, at least 95%, at least 98% or at least 99% identical to the amino acid sequence of SEQ ID NO: 155.

The disclosure also provides a CAR comprising the amino acid sequence of SEQ ID NO: 156.

The disclosure also provides a CAR comprising the amino acid sequence that is at least 80%, at least 85%, at least 90%, at least 95%, at least 98% or at least 99% identical to the amino acid sequence of SEQ ID NO: 156.

The disclosure also provides a CAR comprising the amino acid sequence of SEQ ID NO: 426.

The disclosure also provides a CAR comprising the amino acid sequence that is at least 80% at least 85%, at least 90%, at least 95%, at least 98% or at least 99% identical to the amino acid sequence of SEQ ID NO: 426.

The disclosure also provides a CAR comprising the amino acid sequence of SEQ ID NO: 427.

The disclosure also provides a CAR comprising the amino acid sequence that is at least 80%, at least 85%, at least 90%, at least 95%, at least 98% or at least 99% identical to the amino acid sequence of SEQ ID NO: 427.

The disclosure also provides a CAR comprising the amino acid sequence of SEQ ID NO: 428.

The disclosure also provides a CAR comprising the amino acid sequence that is at least 80%, at least 85%, at least 90%, at least 95%, at least 98% or at least 99% identical to the amino acid sequence of SEQ ID NO:428.

The disclosure also provides a CAR comprising the amino acid sequence of SEQ ID NO: 429.

The disclosure also provides a CAR comprising the amino acid sequence that is at least 80% at least 85%, at least 90%, at least 95%, at least 98% or at least 99% identical to the amino acid sequence of SEQ ID NO: 429.

The disclosure also provides a CAR comprising the amino acid sequence of SEQ ID NO: 430.

The disclosure also provides a CAR comprising the amino acid sequence that is at least 80%, at least 85%, at least 90%, at least 95%, at least 98% or at least 99% identical to the amino acid sequence of SEQ ID NO: 430.

The disclosure also provides a CAR comprising the amino acid sequence of SEQ ID NO: 431.

The disclosure also provides a CAR comprising the amino acid sequence that is at least 80%, at least 85%, at least 90%, at least 95%, at least 98% or at least 99% identical to the amino acid sequence of SEQ ID NO: 431.

The disclosure also provides a CAR comprising the amino acid sequence of SEQ ID NO: 432.

The disclosure also provides a CAR comprising the amino acid sequence that is at least 80%, at least 85%, at least 90%, at least 95%, at least 98% or at least 99% identical to the amino acid sequence of SEQ ID NO: 432.

The disclosure also provides a CAR comprising the amino acid sequence of SEQ ID NO: 433.

The disclosure also provides a CAR comprising the amino acid sequence that is at least 80%, at least 85%, at least 90%, at least 95%, at least 98% or at least 99% identical to the amino acid sequence of SEQ ID NO: 433.

The disclosure also provides a CAR comprising the amino acid sequence of SEQ ID NO: 434.

The disclosure also provides a CAR comprising the amino acid sequence that is at least 80%, at least 85%, at least 90%, at least 95%, at least 98% or at least 99% identical to the amino acid sequence of SEQ ID NO: 434.

The disclosure also provides a CAR comprising the amino acid sequence of SEQ ID NO: 435.

The disclosure also provides a CAR comprising the amino acid sequence that is at least 80%, at least 85%, at least 90%, at least 95%, at least 98% or at least 99% identical to the amino acid sequence of SEQ ID NO: 435.

The disclosure also provides a CAR comprising the amino acid sequence of SEQ ID NO: 436.

The disclosure also provides a CAR comprising the amino acid sequence that is at least 80%, at least 85%, at least 90%, at least 95%, at least 98% or at least 99% identical to the amino acid sequence of SEQ ID NO: 436.

The disclosure also provides a CAR comprising the amino acid sequence of SEQ ID NO: 437.

The disclosure also provides a CAR comprising the amino acid sequence that is at least 80%, at least 85%, at least 90%, at least 95%, at least 98% or at least 99% identical to the amino acid sequence of SEQ ID NO: 437.

The disclosure also provides a CAR comprising the amino acid sequence of SEQ ID NO: 438.

The disclosure also provides a CAR comprising the amino acid sequence that is at least 80%, at least 85%, at least 90%, at least 95%, at least 98% or at least 99% identical to the amino acid sequence of SEQ ID NO: 438.

The disclosure also provides a CAR comprising the amino acid sequence of SEQ ID NO: 439.

The disclosure also provides a CAR comprising the amino acid sequence that is at least 80% at least 85%, at least 90%, at least 95%, at least 98% or at least 99% identical to the amino acid sequence of SEQ ID NO: 439.

The disclosure also provides a CAR comprising the amino acid sequence of SEQ ID NO: 440.

The disclosure also provides a CAR comprising the amino acid sequence that is at least 80%, at least 85%, at least 90%, at least 95%, at least 98% or at least 99% identical to the amino acid sequence of SEQ ID NO: 440.

The disclosure also provides a CAR comprising the amino acid sequence of SEQ ID NO: 441.

The disclosure also provides a CAR comprising the amino acid sequence that is at least 80%, at least 85%, at least 90%, at least 95%, at least 98% or at least 99% identical to the amino acid sequence of SEQ ID NO: 441.

The disclosure also provides a CAR comprising an amino acid sequence which is at least 80% (e.g. at least 90%, at least 95%, at least 98% or at least 99%) identical to the amino acid sequence of SEQ ID NO: 432.

The disclosure also provides a CAR comprising an amino acid sequence which is at least 80% (e.g. at least 90%, at least 95%, at least 98% or at least 99%) identical to the amino acid sequence of SEQ ID NO: 433.

In some embodiments, the CAR comprises an amino acid sequence which is identical to the amino acid sequence of SEQ ID NO: 432 or SEQ ID NO: 433.

In some embodiments, the CAR comprises an amino acid sequence which is at least 80% (e.g. at least 90%, at least 95%, at least 98% or at least 99%) identical to the amino acid sequence of SEQ ID NO: 153, SEQ ID NO: 154, SEQ ID NO: 155 or SEQ ID NO: 156.

In some embodiments, the CAR comprises an amino acid sequence which is at least 80% (e.g. at least 90%, at least 95%, at least 98% or at least 99%) identical to the amino acid sequence of SEQ ID NO: 154.

In some embodiments, the CAR comprises an amino acid sequence which is at least 80% (e.g. at least 90%, at least 95%, at least 98% or at least 99%) identical to the amino acid sequence of SEQ ID NO: 155.

In some embodiments, the CAR comprises an amino acid sequence which is at least 80% (e.g. at least 90%, at least 95%, at least 98% or at least 99%) identical to the amino acid sequence of SEQ ID NO: 156.

In a particular embodiment, the CAR comprises an amino acid sequence which is identical to the amino acid sequence of SEQ ID NO: 153, SEQ ID NO: 154, SEQ ID NO: 155 or SEQ ID NO: 156

In a particular embodiment, the disclosure provides a CAR comprising an extracellular antigen binding domain that binds hK2, a transmembrane domain and an intracellular signaling domain, wherein the extracellular antigen binding domain binds to hK2 at three or more residues within epitopes having sequences of SEQ ID NO: 111 and SEQ ID NO: 112.

CAR Constructs and Immunoresponsive Cells Expressing CARs

The disclosure also provides isolated polynucleotides encoding the CARs described herein.

Unless otherwise specified, a "polynucleotide encoding an amino acid sequence" includes all polynucleotide sequences that are degenerate versions of each other and that encode the same amino acid sequence. The phrase polynucleotide that encodes a protein or a RNA may also include introns to the extent that the polynucleotide encoding the protein may in some variants contain an intron(s) that is spliced into the expressed protein.

The disclosure also provides an expression vector comprising the nucleic acid molecule encoding the CAR of the disclosure.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The disclosure also provides isolated immunoresponsive cells comprising the CAR of the disclosure. In some embodiments, the isolated immunoresponsive cell is transduced with the CAR, for example, the CAR is constitutively expressed on the surface of the immunoresponsive cell. In certain embodiments, the isolated immunoresponsive cell is further transduced with at least one co-stimulatory ligand such that the immunoresponsive cell expresses the at least one co-stimulatory ligand. In certain embodiments, the at least one co-stimulatory ligand is selected from the group consisting of 4-1BBL, CD48, CD70, CD80, CD86, OX40L, TNFRSF14, and combinations thereof. In certain embodiments, the isolated immunoresponsive cell is further transduced with at least one cytokine such that the immunoresponsive cell secretes the at least one cytokine. In certain embodiments, the at least cytokine is selected from the group consisting of IL-2, IL-3, IL-6, IL-7, IL-11, IL-12, IL-15, IL-17, IL-21, and combinations thereof. In some embodiments, the isolated immunoresponsive cell is selected from the group consisting of a T lymphocyte (T cell), a Natural Killer (NK) cell, a cytotoxic T lymphocyte (CTL), a regulatory T cell (Treg), a human embryonic stem cell, a lymphoid progenitor cell, a T cell-precursor cell, and a pluripotent stem cell from which lymphoid cells may be differentiated.

In some embodiments, the isolated immunoresponsive cell is the T cell.

For purposes herein, the T cell can be any T cell, such as a cultured T cell, e.g., a primary T cell, or a T cell from a cultured T cell line, e.g., Jurkat, SupT1, etc., or a T cell obtained from a mammal. If obtained from a mammal, the T cell can be obtained from numerous sources, including but not limited to bone marrow, blood, lymph node, the thymus, or other tissues or fluids. T cells can also be enriched for or purified. The T cell may be a human T cell. The T cell may be a T cell isolated from a human. The T cell can be any type of T cell and can be of any developmental stage, including but not limited to, $CD4^+/CD8^+$ double positive T cells, $CD8^+$ T cells (e.g., cytotoxic T cells). $CD4^+$ helper T cells, e.g., Th1 and Th2 cells, peripheral blood mononuclear cells (PBMCs), peripheral blood leukocytes (PBLs), tumor infiltrating cells, memory T cells, naïve T cells, and the like. The T cell may be a $CD8^+$ T cell or a $CD4^+$ T cell.

In some embodiments, the isolated immunoresponsive cell is the NK cell.

In some embodiments, the isolated immunoresponsive cell is the CTL.

In some embodiments, the isolated immunoresponsive cell is the Treg.

In some embodiments, the isolated immunoresponsive cell is the human embryonic stem cell.

In some embodiments, the isolated immunoresponsive cell is the lymphoid progenitor cell.

In some embodiments, the isolated immunoresponsive cell is the pluripotent stem cell.

In one embodiment, the CAR T cells of the disclosure can be generated by introducing a lentiviral vector comprising a desired CAR, for example, a CAR comprising an extracellular domain comprising an antigen binding domain that binds hK2, CD8α hinge and transmembrane domain, and human 4-1BB and CD3-zeta signaling domains, into the cells. The CAR T cells of the disclosure are able to replicate in vivo resulting in long-term persistence that can lead to sustained tumor control.

Embodiments of the invention further provide host cells comprising any of the recombinant expression vectors described herein. As used herein, the term "host cell" refers to any type of cell that can contain the recombinant expression vector. The host cell can be a eukaryotic cell, e.g., plant, animal, or algae, fungi, or can be a prokaryotic cell, e.g., bacteria or protozoa. The host cell can be a cultured cell or a primary cell, i.e., isolated directly from an organism. e.g., a human. The host cell can be an adherent cell or a suspended cell, i.e., a cell that grows in suspension. Suitable host cells are known in the art and include, for instance, DH5α *E. coli* cells, Chinese hamster ovarian cells, monkey VERO cells, COS cells, HEK293 cells, and the like. For purposes of amplifying or replicating the recombinant expression vector, the host cell may be a prokaryotic cell, e.g., a DH5α cell. For purposes of producing a recombinant CAR, polypeptide, or protein, the host cell may be a mammalian cell. The host cell may be a human cell. While the host cell can be of any cell type, can originate from any type of tissue, and can be of any developmental stage, the host cell may be a peripheral blood lymphocyte (PBL). The host cell may be a T cell.

Also provided are a population of cells comprising at least one host cell described herein. The population of cells can be a heterogeneous population comprising the host cell comprising any of the recombinant expression vectors described, in addition to at least one other cell, e.g., a host cell (e.g., a T cell), which does not comprise any of the recombinant expression vectors, or a cell other than a T cell, e.g., a B cell, a macrophage, an erythrocyte, a neutrophil, a hepatocyte, an endothelial cell, an epithelial cell, a muscle cell, a brain cell, etc. Alternatively, the population of cells can be a substantially homogeneous population, in which the population comprises mainly host cells (e.g., consisting essentially of) comprising the recombinant expression vector. The population also can be a clonal population of cells, in which all cells of the population are clones of a single host cell comprising a recombinant expression vector, such that all cells of the population comprise the recombinant expression vector. In one embodiment, the population of cells is a clonal population comprising host cells comprising a recombinant expression vector as described herein.

Polynucleotides, Host Cells and Vectors

The disclosure also provides an isolated polynucleotide encoding any of the hK2 binding proteins of the disclosure. The hK2 binding protein includes the antigen binding domains that bind hK2, the proteins comprising the antigen binding domains that bind hK2, the multispecific proteins that comprise the antigen binding domains that bind hK2 and the chimeric antigen receptors (CAR) comprising the antigen binding domains that bind hK2 of the disclosure.

The invention also provides an isolated polynucleotide encoding any of hK2 biding proteins or fragments thereof.

The invention also provides an isolated polynucleotide encoding the VH of SEQ ID NO: 137.

The invention also provides an isolated polynucleotide encoding the VH of SEQ ID NO: 162.

The invention also provides an isolated polynucleotide encoding the VH of SEQ ID NO: 164.

The invention also provides an isolated polynucleotide encoding the VH of SEQ ID NO: 166.

The invention also provides an isolated polynucleotide encoding the VH of SEQ ID NO: 168.

The invention also provides an isolated polynucleotide encoding the VH of SEQ ID NO: 204.

The invention also provides an isolated polynucleotide encoding the VH of SEQ ID NO: 159.

The invention also provides an isolated polynucleotide encoding the VH of SEQ ID NO: 161.

The invention also provides an isolated polynucleotide encoding the VH of SEQ ID NO: 139.

The invention also provides an isolated polynucleotide encoding the VH of SEQ ID NOs: 4, 5 or 6.

The invention also provides an isolated polynucleotide encoding the VH of SEQ ID NO: 75.

The invention also provides an isolated polynucleotide encoding the VL of SEQ ID NO: 138.

The invention also provides an isolated polynucleotide encoding the VL of SEQ ID NO: 163.

The invention also provides an isolated polynucleotide encoding the VL of SEQ ID NO: 165.

The invention also provides an isolated polynucleotide encoding the VL of SEQ ID NO: 167.

The invention also provides an isolated polynucleotide encoding the VL of SEQ ID NO: 169.

The invention also provides an isolated polynucleotide encoding the VL of SEQ ID NO: 205.

The invention also provides an isolated polynucleotide encoding the VL of SEQ ID NO: 140.

The invention also provides an isolated polynucleotide encoding the VL of SEQ ID NO: 160.

The invention also provides an isolated polynucleotide encoding the VL of SEQ ID NO: 74.

The invention also provides an isolated polynucleotide encoding the VL of SEQ ID NOs: 1, 2 or 3.

The invention also provides for an isolated polynucleotide encoding
the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169;
the VH of SEQ ID NO: 204 and the VL of SEQ ID NO: 205;
the VH of SEQ ID NO: 159 and the VL of SEQ ID NO: 160;
the VH of SEQ ID NO: 161 and the VL of SEQ ID NO: 140;
the VH of SEQ ID NO: 139 and the VL of SEQ ID NO: 140;
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 5 and the VL of SEQ ID NO: 1;
the VH of SEQ ID NO: 5 and the VL of SEQ ID NO: 3;
the VH of SEQ ID NO: 6 and the VL of SEQ ID NO: 1;
the VH of SEQ ID NO: 6 and the VL of SEQ ID NO: 2; or
the VH of SEQ ID NO: 6 and the VL of SEQ ID NO: 3.

In a particular embodiment, the invention provides an isolated polynucleotide encoding the VH of SEQ ID NO: 162 and/or an isolated polynucleotide encoding the VL of SEQ ID NO: 163.

The invention also provides an isolated polynucleotide encoding the polypeptide of SEQ ID NOs: SEQ ID NOs: 8, 9, 10, 11, 12, 13, 14, 15, 16, 17, 18, 19, 20, 21, 22, 23, 133, 134, 135, 136, 308, 316, 318, 319, 320, 321, 322, 323, 324, 325, 404, 405, 406, 407, 408, or 409.

The invention also provides an isolated polynucleotide encoding the polypeptide of SEQ ID NOs: 29, 30, 31, 32, 33, 34, 35, 36, 37, 38, 39, 40, 41, 42, 43, 44, 149, 150, 151, 152, 410, 411, 412, 413, 414, 415, 416, 417, 418, 419, 420, 421, 422, 423, 424, or 425.

In some embodiments, the isolated polynucleotide sequence encoding an hK2 binding protein of the disclosure is at least 85% identical with the polynucleotide of SEQ ID NOs: 225, 226, 227, 228, 229, 230, 231, 232, 233, 234, 235, 236, 237, 238, 239, 240, 241, 242, 243, 244, 245, 246, 247, 263, 271, 273, 274, 275, 276, 277, 278, 279, 280, 281, 282, 283, 292, 293, 294, 295, 296, 297, 303, 304, 305, 306, 312, 316, 317, 363, 364, 365, 366, 367, 368, 369, 370, 371, 372, 373, 374, 446, 450 or 451.

In some embodiments, the isolated polynucleotide sequence encoding an hK2 binding protein of the disclosure is at least 90% identical with the polynucleotide of SEQ ID NOs: 225, 226, 227, 228, 229, 230, 231, 232, 233, 234, 235, 236, 237, 238, 239, 240, 241, 242, 243, 244, 245, 246, 247, 263, 271, 273, 274, 275, 276, 277, 278, 279, 280, 281, 282, 283, 292, 293, 294, 295, 296, 297, 303, 304, 305, 306, 312, 316, 317, 363, 364, 365, 366, 367, 368, 369, 370, 371, 372, 373, 374, 446, 450 or 451.

In some embodiments, the isolated polynucleotide sequence encoding an hK2 binding protein of the disclosure is at least 95% identical with the polynucleotide of SEQ ID NOs: 225, 226, 227, 228, 229, 230, 231, 232, 233, 234, 235, 236, 237, 238, 239, 240, 241, 242, 243, 244, 245, 246, 247, 263, 271, 273, 274, 275, 276, 277, 278, 279, 280, 281, 282, 283, 292, 293, 294, 295, 296, 297, 303, 304, 305, 306, 312, 316, 317, 363, 364, 365, 366, 367, 368, 369, 370, 371, 372, 373, 374, 446, 450 or 451.

In some embodiments, the isolated polynucleotide sequence encoding an hK2 binding protein of the disclosure is at least 98% identical with the polynucleotide of SEQ ID NOs: 225, 226, 227, 228, 229, 230, 231, 232, 233, 234, 235, 236, 237, 238, 239, 240, 241, 242, 243, 244, 245, 246, 247, 263, 271, 273, 274, 275, 276, 277, 278, 279, 280, 281, 282, 283, 292, 293, 294, 295, 296, 297, 303, 304, 305, 306, 312, 316, 317, 363, 364, 365, 366, 367, 368, 369, 370, 371, 372, 373, 374, 446, 450 or 451.

In some embodiments, the isolated polynucleotide sequence encoding an hK2 binding protein of the disclosure is at least 99% identical with the polynucleotide of SEQ ID NOs: 225, 226, 227, 228, 229, 230, 231, 232, 233, 234, 235, 236, 237, 238, 239, 240, 241, 242, 243, 244, 245, 246, 247, 263, 271, 273, 274, 275, 276, 277, 278, 279, 280, 281, 282, 283, 292, 293, 294, 295, 296, 297, 303, 304, 305, 306, 312, 316, 317, 363, 364, 365, 366, 367, 368, 369, 370, 371, 372, 373, 374, 446, 450 or 451.

The invention also provides an isolated polynucleotide of SEQ ID NOs: 225, 226, 227, 228, 229, 230, 231, 232, 233, 234, 235, 236, 237, 238, 239, 240, 241, 242, 243, 244, 245, 246, 247, 263, 267, 271, 267, 274, 282, 292, 293, 294, 295, 303, 304, 305, 306, 312, 316, 363, 364, 365, 367, 368, 369, 370, 371, 372, 373, or 374.

The invention also provides an isolated polynucleotide of SEQ ID NOs: 225, 226, 227, 228, 229, 230, 231, 232, 233, 234, 235, 236, 237, 238, 239, 240, 241, 242, 243, 244, 245, 246, 247, 263, 271, 273, 274, 275, 276, 277, 278, 279, 280, 281, 282, 283, 292, 293, 294, 295, 296, 297, 303, 304, 305, 306, 312, 316, 317, 363, 364, 365, 366, 367, 368, 369, 370, 371, 372, 373, 374, 446, 450 or 451. In a particular embodiment, the disclosure provides an isolated polynucleotide sequence encoding a polypeptide sequence of SEQ ID NO: 354.

In a particular embodiment, the disclosure provides an isolated polynucleotide sequence encoding a polypeptide sequence of SEQ ID NO: 221.

In a particular embodiment, the disclosure provides an isolated polynucleotide sequence encoding a polypeptide sequence of SEQ ID NO: 360.

In a particular embodiment, the disclosure provides isolated polynucleotide sequences encoding polypeptide sequences of SEQ ID NOs: 354, 221 and 360.

In a particular embodiment, the disclosure provides an isolated polynucleotide sequence which is at least 80% (e.g. at least 85%, at least 90%, at least 95% or at least 99%, or 100%) identical to the polynucleotide of SEQ ID NO: 367.

In a particular embodiment, the disclosure provides an isolated polynucleotide sequence which is at least 80% (e.g. at least 85%, at least 90%, at least 95% or at least 99% or 100%) identical to the polynucleotide of SEQ ID NO: 303.

In a particular embodiment, the disclosure provides an isolated polynucleotide sequence which is at least 80% (e.g. at least 85%, at least 90%, at least 95% or at least 99% or 100%) identical to the polynucleotide of SEQ ID NO: 373.

In a particular embodiment, the disclosure provides an isolated polynucleotide sequence encoding a polypeptide sequence of SEQ ID NO: 361.

In a particular embodiment, the disclosure provides an isolated polynucleotide sequence encoding a polypeptide sequence of SEQ ID NO: 221.

In a particular embodiment, the disclosure provides an isolated polynucleotide sequence encoding a polypeptide sequence of SEQ ID NO: 362. In a particular embodiment, the disclosure provides isolated polynucleotide sequences encoding polypeptide sequences of SEQ ID NOs: 361, 221 and 362.

In a particular embodiment, the disclosure provides an isolated polynucleotide sequence which is at least 80% (e.g. at least 85%, at least 90%, at least 95% or at least 99% or 100%) identical to the polynucleotide of SEQ ID NO: 370.

In a particular embodiment, the disclosure provides an isolated polynucleotide sequence which is at least 80% (e.g. at least 85%, at least 90%, at least 95% or at least 99% or 100%) identical to the polynucleotide of SEQ ID NO: 303.

In a particular embodiment, the disclosure provides an isolated polynucleotide sequence which is at least 80% (e.g. at least 85%, at least 90%, at least 95% or at least 99% or 100%) identical to the polynucleotide of SEQ ID NO: 374.

Some embodiments of the disclosure also provide an isolated or purified nucleic acid comprising a polynucleotide which is complementary to the polynucleotides encoding the hK2 binding proteins of the disclosure or polynucleotides which hybridize under stringent conditions to the polynucleotides encoding the hK2 binding proteins of the disclosure.

The polynucleotides which hybridize under stringent conditions may hybridize under high stringency conditions. By "high stringency conditions" is meant that the polynucleotide specifically hybridizes to a target sequence (the nucleotide sequence of any of the nucleic acids described herein) in an amount that is detectably stronger than non-specific hybridization. High stringency conditions include conditions which would distinguish a polynucleotide with an exact complementary sequence, or one containing only a few scattered mismatches from a random sequence that happened to have a few small regions (e.g., 3-12 bases) that matched the nucleotide sequence. Such small regions of complementarity are more easily melted than a full-length complement of 14-17 or more bases, and high stringency hybridization makes them easily distinguishable. Relatively high stringency conditions would include, for example, low salt and/or high temperature conditions, such as provided by about 0.02-0.1 M NaCl or the equivalent, at temperatures of about 50-70° C. Such high stringency conditions tolerate little, if any, mismatch between the nucleotide sequence and the template or target strand, and are particularly suitable for detecting expression of any of the CARs described herein. It is generally appreciated that conditions can be rendered more stringent by the addition of increasing amounts of formamide.

The polynucleotide sequences of the disclosure may be operably linked to one or more regulatory elements, such as a promoter or enhancer, that allow expression of the nucleotide sequence in the intended host cell. The polynucleotide may be a cDNA. The promoter bay be a strong, weak, tissue-specific, inducible or developmental-specific promoter. Exemplary promoters that may be used are hypoxanthine phosphoribosyl transferase (HPRT), adenosine deaminase, pyruvate kinase, beta-actin, human myosin, human hemoglobin, human muscle creatine, and others. In addition, many viral promoters function constitutively in eukaryotic cells and are suitable for use with the described embodiments. Such viral promoters include Cytomegalovirus (CMV) immediate early promoter, the early and late promoters of SV40, the Mouse Mammary Tumor Virus (MMTV) promoter, the long terminal repeats (LTRs) of Maloney leukemia virus Human Immunodeficiency Virus (HIV) Epstein Barr Virus (EBV), Rous Sarcoma Virus (RSV), and other retroviruses, and the thymidine kinase promoter of Herpes Simplex Virus. Inducible promoters such as the metallothionein promoter, tetracycline-inducible promoter, doxycycline-inducible promoter, promoters that contain one or more interferon-stimulated response elements (ISRE) such as protein kinase R 2',5'-oligoadenylate synthetases, Mx genes, ADAR1, and the like may also be sued.

The invention also provides a vector comprising the polynucleotide of the invention. The disclosure also provides an expression vector comprising the polynucleotide of the invention. Such vectors may be plasmid vectors, viral vectors, vectors for baculovirus expression, transposon-based vectors or any other vector suitable for introduction of the synthetic polynucleotide of the invention into a given organism or genetic background by any means. Polynucleotides encoding the hK2 binding proteins of the disclosure may be operably linked to control sequences in the expression vector(s) that ensure the expression of the hK2 binding proteins. Such regulatory elements may include a transcriptional promoter, sequences encoding suitable mRNA ribosomal binding sites, and sequences that control the termination of transcription and translation. Expression vectors may also include one or more nontranscribed elements such as an origin of replication, a suitable promoter and enhancer linked to the gene to be expressed, other 5' or 3' flanking nontranscribed sequences, 5' or 3' nontranslated sequences (such as necessary ribosome binding sites), a polyadenylation site, splice donor and acceptor sites, or transcriptional termination sequences. An origin of replication that confers the ability to replicate in a host may also be incorporated.

The expression vectors can comprise naturally-occurring or non-naturally-occurring internucleotide linkages, or both types of linkages. The non-naturally occurring or altered nucleotides or internucleotide linkages do not hinder the transcription or replication of the vector.

Once the vector has been incorporated into the appropriate host, the host is maintained under conditions suitable for high level expression of the hK2 binding proteins of the disclosure encoded by the incorporated polynucleotides. The transcriptional and translational control sequences in expression vectors to be used in transforming vertebrate cells may be provided by viral sources. Exemplary vectors may be constructed as described by Okayama and Berg, 3 *Mol. Cell. Biol.* 280 (1983).

Vectors of the disclosure may also contain one or more Internal Ribosome Entry Site(s) (IRES). Inclusion of an IRES sequence into fusion vectors may be beneficial for enhancing expression of some proteins. In some embodiments, the vector system will include one or more polyadenylation sites (e.g., SV40), which may be upstream or downstream of any of the aforementioned nucleic acid sequences. Vector components may be contiguously linked or arranged in a manner that provides optimal spacing for expressing the gene products (i.e., by the introduction of "spacer" nucleotides between the ORFs) or positioned in another way. Regulatory elements, such as the IRES motif, may also be arranged to provide optimal spacing for expression.

Vectors of the disclosure may be circular or linear. They may be prepared to contain a replication system functional in a prokaryotic or eukaryotic host cell. Replication systems can be derived, e.g., from ColE1, SV40, 2µ plasmid, λ, bovine papilloma virus, and the like.

The recombinant expression vectors can be designed for either transient expression, for stable expression, or for both. Also, the recombinant expression vectors can be made for constitutive expression or for inducible expression.

Further, the recombinant expression vectors can be made to include a suicide gene. As used herein, the term "suicide gene" refers to a gene that causes the cell expressing the suicide gene to die. The suicide gene can be a gene that confers sensitivity to an agent, e.g., a drug, upon the cell in which the gene is expressed, and causes the cell to die when the cell is contacted with or exposed to the agent. Suicide genes are known in the art and include, for example, the Herpes Simplex Virus (HSV) thymidine kinase (TK) gene, cytosine daminase, purine nucleoside phosphorylase, and nitroreductase.

The vectors may also comprise selection markers, which are well known in the art. Selection markers include positive and negative selection marker. Marker genes include biocide resistance, e.g., resistance to antibiotics, heavy metals, etc., complementation in an auxotrophic host to provide prototrophy, and the like. Exemplary marker genes include antibiotic resistance genes (e.g., neomycin resistance gene, a hygromycin resistance gene, a kanamycin resistance gene, a tetracycline resistance gene, a penicillin resistance gene, histidinol resistance gene, histidinol×resistance gene), glutamine synthase genes, HSV-TK, HSV-TK derivatives for ganciclovir selection, or bacterial purine nucleoside phosphorylase gene for 6-methylpurine selection (Gadi et al., 7 *Gene Ther.* 1738-1743 (2000)). A nucleic acid sequence encoding a selection marker or the cloning site may be upstream or downstream of a nucleic acid sequence encoding a polypeptide of interest or cloning site.

Exemplary vectors that may be used are Bacterial: pBs, phagescript, PsiX174, pBluescript SK, pBs KS, pNH8a, pNH16a, pNH18a, pNH46a (Stratagene, La Jolla, Calif., USA); pTrc99A, pKK223-3, pKK233-3, pDR540, and pRIT5 (Pharmacia, Uppsala, Sweden). Eukaryotic: pWLneo, pSV2cat, pOG44, PXR1, pSG (Stratagene) pSVK3, pBPV, pMSG and pSVL (Pharmacia), pEE6.4 (Lonza) and pEE12.4 (Lonza). Additional vectors include the pUC series (Fermentas Life Sciences, Glen Burnie, Md.), the pBluescript series (Stratagene, LaJolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGT10, λGT11, λEMBL4, and λNM1149, λZapII (Stratagene) can be used. Exemplary plant expression vectors include pBI01, pBI01.2, pBI121, pBI101.3, and pBIN19 (Clontech). Exemplary animal expression vectors include pEUK-Cl, pMAM, and pMAMneo (Clontech). The expression vector may be a viral vector, e.g., a retroviral vector, e.g., a gamma retroviral vector.

In some embodiments, the vector comprises the polynucleotide encoding the VH of SEQ ID NO: 137.

In some embodiments, the vector comprises the polynucleotide encoding the VH of SEQ ID NO: 162.

In some embodiments, the vector comprises the polynucleotide encoding the VH of SEQ ID NO: 164.

In some embodiments, the vector comprises the polynucleotide encoding the VH of SEQ ID NO: 166.

In some embodiments, the vector comprises the polynucleotide encoding the VH of SEQ ID NO: 168.

In some embodiments, the vector comprises the polynucleotide encoding the VH of SEQ ID NO: 204.

In some embodiments, the vector comprises the polynucleotide encoding the VH of SEQ ID NO: 159.

In some embodiments, the vector comprises the polynucleotide encoding the VH of SEQ ID NO: 161.

In some embodiments, the vector comprises the polynucleotide encoding the VH of SEQ ID NO: 139.

In some embodiments, the vector comprises the polynucleotide encoding the VH of SEQ ID NOs: 4, 5 or 6.

In some embodiments, the vector comprises the polynucleotide encoding the VH of SEQ ID NO: 75.

In some embodiments, the vector comprises the polynucleotide encoding the VH of SEQ ID NO: 138.

In some embodiments, the vector comprises the polynucleotide encoding the VH of SEQ ID NO: 163.

In some embodiments, the vector comprises the polynucleotide encoding the VH of SEQ ID NO: 165.

In some embodiments, the vector comprises the polynucleotide encoding the VH of SEQ ID NO: 167.

In some embodiments, the vector comprises the polynucleotide encoding the VH of SEQ ID NO: 169.

In some embodiments, the vector comprises the polynucleotide encoding the VH of SEQ ID NO: 205.

In some embodiments, the vector comprises the polynucleotide encoding the VH of SEQ ID NO: 140.

In some embodiments, the vector comprises the polynucleotide encoding the VH of SEQ ID NO: 160.

In some embodiments, the vector comprises the polynucleotide encoding the VH of SEQ ID NO: 74.

In some embodiments, the vector comprises the polynucleotide encoding the VH of SEQ ID NOs: 1, 2 or 3.

In some embodiments, the vector comprises the polynucleotide encoding
the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169;
the VH of SEQ ID NO: 204 and the VL of SEQ ID NO: 205;
the VH of SEQ ID NO: 159 and the VL of SEQ ID NO: 160;
the VH of SEQ ID NO: 161 and the VL of SEQ ID NO: 140;
the VH of SEQ ID NO: 139 and the VL of SEQ ID NO: 140;
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 5 and the VL of SEQ ID NO: 1;
the VH of SEQ ID NO: 5 and the VL of SEQ ID NO: 3;
the VH of SEQ ID NO: 6 and the VL of SEQ ID NO: 1;
the VH of SEQ ID NO: 6 and the VL of SEQ ID NO: 2; or
the VH of SEQ ID NO: 6 and the VL of SEQ ID NO: 3.

In some embodiments, the vector comprises the polynucleotide encoding polypeptide of SEQ ID NOs: SEQ ID NOs: 8, 9, 10, 11, 12, 13, 14, 15, 16, 17, 18, 19, 20, 21, 22, 23, 133, 134, 135, 136, 308, 316, 318, 319, 320, 321, 322, 323, 324, 325, 404, 405, 406, 407, 408, or 409.

In some embodiments, the vector comprises the polynucleotide encoding the polypeptide of SEQ ID NOs: 29, 30, 31, 32, 33, 34, 35, 36, 37, 38, 39, 40, 41, 42, 43, 44, 149, 150, 151, 152, 410, 411, 412, 413, 414, 415, 416, 417, 418, 419, 420, 421, 422, 423, 424, or 425.

In a particular embodiment, the vector comprises the polynucleotide encoding the polypeptide sequence of SEQ ID NO: 354. In a particular embodiment, the vector comprises the polynucleotide encoding the polypeptide sequence of SEQ ID NO: 221. In a particular embodiment, the vector comprises the polynucleotide encoding the polypeptide sequence of SEQ ID NO: 360. In some embodiments, the disclosure provides a vector the polypeptide sequences of SEQ ID NOs: 354, 221 and 360.

In a particular embodiment, the vector comprises the polynucleotide of SEQ ID NO: 367. In a particular embodiment, the vector comprises the polynucleotide of SEQ ID NO: 303. In a particular embodiment, the vector comprises the polynucleotide of SEQ ID NO: 373. In some embodiments, the vector comprises the polynucleotide sequences of SEQ ID NOs: 367, 303 and 373.

In a particular embodiment, the vector comprises the polynucleotide encoding the polypeptide sequence of SEQ ID NO: 361. In a particular embodiment, the vector comprises the polynucleotide encoding the polypeptide sequence of SEQ ID NO: 221. In a particular embodiment, the vector comprises the polynucleotide encoding the polypeptide sequence of SEQ ID NO: 362.

In a particular embodiment, the vector comprises the polynucleotide of SEQ ID NO: 370. In a particular embodiment, the vector comprises the polynucleotide of SEQ ID NO: 303. In a particular embodiment, the vector comprises the polynucleotide of SEQ ID NO: 374.

The invention also provides for a host cell comprising one or more vectors of the invention. "Host cell" refers to a cell into which a vector has been introduced. It is understood that the term host cell is intended to refer not only to the particular subject cell but to the progeny of such a cell, and also to a stable cell line generated from the particular subject cell. Because certain modifications may occur in succeeding generations due to either mutation or environmental influences, such progeny may not be identical to the parent cell, but are still included within the scope of the term "host cell" as used herein. Such host cells may be eukaryotic cells, prokaryotic cells, plant cells or archeal cells. *Escherichia coli*, bacilli, such as *Bacillus subtilis*, and other enterobacteriaceae, such as *Salmonella, Serratia*, and various *Pseudomonas* species are examples of prokaryotic host cells. Other microbes, such as yeast, are also useful for expression. *Saccharomyces* (e.g., *S. cerevisiae*) and *Pichia* are examples of suitable yeast host cells. Exemplary eukaryotic cells may be of mammalian, insect, avian or other animal origins. Mammalian eukaryotic cells include immortalized cell lines such as hybridomas or myeloma cell lines such as SP2/0 (American Type Culture Collection (ATCC), Manassas, Va., CRL-1581), NS0 (European Collection of Cell Cultures (ECACC), Salisbury, Wiltshire, UK, ECACC No. 85110503). FO (ATCC CRL-1646) and Ag653 (ATCC CRL-1580) murine cell lines. An exemplary human myeloma cell line is U266 (ATTC CRL-TIB-196). Other useful cell lines include those derived from Chinese Hamster Ovary (CHO) cells such as CHO-K1SV (Lonza Biologics, Walkersville, Md.), CHO-K1 (ATCC CRL-61) or DG44.

The disclosure also provides a method of producing the hK2 binding protein of the disclosure comprising culturing the host cell of the disclosure in conditions that the hK2 binding protein is expressed, and recovering the hK2 binding protein produced by the host cell. Methods of making proteins and purifying them are known. Once synthesized (either chemically or recombinantly), the hK2 binding proteins may be purified according to standard procedures, including ammonium sulfate precipitation, affinity columns, column chromatography, high performance liquid chromatography (HPLC) purification, gel electrophoresis, and the like (see generally Scopes, Protein Purification (Springer-Verlag, N.Y., (1982)). A subject protein may be substantially pure, e.g., at least about 80% to 85% pure, at least about 85% to 90% pure, at least about 90% to 95% pure, or at least about 98% to 99%, or more, pure, e.g., free from contaminants such as cell debris, macromolecules, etc. other than the subject protein The polynucleotides encoding the hK2 binding proteins of the disclosure may be incorporated into vectors using standard molecular biology methods. Host cell transformation, culture, antibody expression and purification are done using well known methods.

Modified nucleotides may be used to generate the polynucleotides of the disclosure. Exemplary modified nucleotides are 5-fluorouracil, 5-bromouracil, 5-chlorouracil, 5-iodouracil, hypoxanthine, xanthine, 4-acetylcytosine, 5-(carboxyhydroxymethyl) uracil, carboxymethylaminomethyl-2-thiouridine, 5-carboxymethylaminomethyluracil, dihydrouracil, $N^6$-substituted adenine, 7-methylguanine, 5-methylaminomethyluracil, 5-methoxyaminomethyl-2-thiouracil, beta-D-mannosylqueosine, 5"-methoxycarboxymethyluracil, 5-methoxyuracil, 2-methylthio-$N^6$-isopentenyladenine, uracil-5-oxyacetic acid (v), wybutoxosine, pseudouracil, queuosine, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine.

Pharmaceutical Compositions/Administration

The disclosure also provides a pharmaceutical composition comprising the hK2 binding protein of the disclosure and a pharmaceutically acceptable carrier.

The disclosure also provides a pharmaceutical composition comprising the antigen binding domain that binds hK2 of the disclosure and a pharmaceutically acceptable carrier.

The disclosure also provides a pharmaceutical composition comprising the protein comprising the antigen binding domain that binds hK2 of the disclosure and a pharmaceutically acceptable carrier.

The disclosure also provides a pharmaceutical composition comprising the multispecific protein comprising the antigen binding domain that binds hK2 of the disclosure and a pharmaceutically acceptable carrier.

The disclosure also provides a pharmaceutical composition comprising the CAR comprising the antigen binding domain that binds hK2 of the disclosure and a pharmaceutically acceptable carrier.

For therapeutic use, the hK2 binding protein of the disclosure may be prepared as pharmaceutical compositions containing an effective amount of the antibody as an active ingredient in a pharmaceutically acceptable carrier. "Carrier" refers to a diluent, adjuvant, excipient, or vehicle with which the antibody of the invention is administered. Such vehicles may be liquids, such as water and oils, including those of petroleum, animal, vegetable or synthetic origin, such as peanut oil, soybean oil, mineral oil, sesame oil and the like. For example, 0.4% saline and 0.3% glycine may be used. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc. The concentration of the antibodies of the invention in such pharmaceutical formulation may vary, from less than about 0.5%, usually to at least about 1% to as much as 15 or 20% by weight and may be selected primarily based on required dose, fluid volumes, viscosities, etc., according to the mode of administration selected. Suitable vehicles and formulations, inclusive of other human proteins, e.g., human serum albumin, are described, for example, in e.g. Remington: The Science and Practice of Pharmacy, 21st Edition, Troy, D. B. ed., Lipincott Williams and Wilkins, Philadelphia, Pa. 2006, Part 5, Pharmaceutical Manufacturing pp 691-1092, See especially pp. 958-989.

The mode of administration of the hK2 binding protein of the disclosure may be any suitable route such as parenteral administration, e.g., intradermal, intramuscular, intraperitoneal, intravenous or subcutaneous, transmucosal (oral, intranasal, intravaginal, rectal) or other means appreciated by the skilled artisan, as known in the art.

In embodiments of the present disclosure, the CAR-expressing cells may be provided in compositions, e.g., suitable pharmaceutical composition(s) comprising the CAR-expressing cells and a pharmaceutically acceptable carrier. In one aspect, the present disclosure provides pharmaceutical compositions comprising an effective amount of a lymphocyte expressing one or more of the CARs described and a pharmaceutically acceptable excipient. Pharmaceutical compositions of the present disclosure may comprise a CAR-expressing cell, e.g., a plurality of CAR-expressing cells, as described herein, in combination with one or more pharmaceutically or physiologically acceptable carriers, excipients or diluents. A pharmaceutically acceptable carrier can be an ingredient in a pharmaceutical composition, other than an active ingredient, which is nontoxic to the subject.

A pharmaceutically acceptable carrier can include a buffer, excipient, stabilizer, or preservative. Examples of pharmaceutically acceptable carriers are solvents, dispersion media, coatings, antibacterial and antifungal agents, isotonic and absorption delaying agents, and the like that are physiologically compatible, such as salts, buffers, antioxidants, saccharides, aqueous or non-aqueous carriers, preservatives, wetting agents, surfactants or emulsifying agents, or combinations thereof. The amounts of pharmaceutically acceptable carrier(s) in the pharmaceutical compositions may be determined experimentally based on the activities of the carrier(s) and the desired characteristics of the formulation, such as stability and/or minimal oxidation. The term "pharmaceutically acceptable," as used herein with regard to pharmaceutical compositions, means approved by a regulatory agency of the Federal or a state government or listed in the U.S. Pharmacopeia or other generally recognized pharmacopeia for use in animals and/or in humans.

Method of Treatment and Uses

The disclosure also provides a method of treating a hK2 expressing cancer in a subject, comprising administering a therapeutically effective amount of the antigen biding domain that binds hK2 of the disclosure to the subject in need thereof for a time sufficient to treat the hK2 expressing cancer.

The disclosure also provides a method of treating a hK2 expressing cancer in a subject, comprising administering a therapeutically effective amount of the protein comprising the antigen biding domain that binds hK2 of the disclosure to the subject for a time sufficient to treat the hK2 expressing cancer The disclosure also provides a method of treating a hK2 expressing cancer in a subject, comprising administering a therapeutically effective amount of the multispecific protein comprising the antigen biding domain that binds hK2 of the disclosure to the subject for a time sufficient to treat the hK2 expressing cancer.

The disclosure also provides a method of treating a hK2 expressing cancer in a subject, comprising administering a therapeutically effective amount of the CAR comprising the antigen biding domain that binds hK2 of the disclosure to the subject for a time sufficient to treat the hK2 expressing cancer.

The disclosure also provides a method of treating a hK2 expressing cancer in a subject, comprising administering a therapeutically effective amount of the immunoconjugate comprising the antigen biding domain that binds hK2 of the disclosure to the subject for a time sufficient to treat the hK2 expressing cancer.

The disclosure also provides a method of treating a hK2 expressing cancer in a subject, comprising administering a therapeutically effective amount of the pharmaceutical composition comprising the antigen biding domain that binds hK2 of the disclosure to the subject for a time sufficient to treat the hK2 expressing cancer.

The disclosure also provides a method of administering a genetically modified T cell expressing a CAR for the treatment of a subject having cancer or at risk of having cancer using lymphocyte infusion.

In at least one embodiment, autologous lymphocyte infusion is used in the treatment. Autologous PBMCs are collected from a subject in need of treatment and T cells are activated and expanded using the methods described herein and known in the art and then infused back into the subject.

In one aspect, the disclosure relates generally to the treatment of a subject at risk of developing cancer. The invention also includes treating a malignancy or an autoimmune disease in which chemotherapy and/or immunotherapy results in significant immunosuppression in a subject, thereby increasing the risk of the subject developing cancer.

The disclosure also provides a method of treating a noncancerous condition in a subject at risk of developing a cancerous condition, comprising administering the antigen binding domain that bind hK2 of the disclosure to the subject to treat the noncancerous condition.

The disclosure also provides a method of treating a noncancerous condition in a subject at risk of developing a cancerous condition, comprising administering the protein comprising the antigen binding domain that bind hK2 of the disclosure to the subject to treat the noncancerous condition.

The disclosure also provides a method of treating a noncancerous condition in a subject at risk of developing a cancerous condition, comprising administering the multispecific protein comprising the antigen binding domain that bind hK2 of the disclosure to the subject to treat the noncancerous condition.

The disclosure also provides a method of treating a noncancerous condition in a subject at risk of developing a cancerous condition, comprising administering the immunoconjugate of the disclosure to the subject to treat the noncancerous condition.

The disclosure also provides a method of treating a noncancerous condition in a subject at risk of developing a cancerous condition, comprising administering the pharmaceutical composition of the disclosure to the subject to treat the noncancerous condition.

The disclosure also provides a method of treating a noncancerous condition in a subject at risk of developing a cancerous condition, comprising administering the CAR of the disclosure to the subject to treat the noncancerous condition.

In some embodiments, the subject at risk of developing the cancerous condition has an enlarged prostate.

In some embodiments, the subject at risk of developing the cancerous condition has a benign prostate hyperplasia (BPH).

In some embodiments, the subject at risk of developing the cancerous condition has a and high PSA levels in absence of diagnosed prostate cancer.

The disclosure also provides a method of preventing hK2 expressing cancer in a subject, comprising administering a therapeutically effective amount of the antigen biding domain that binds hK2 of the disclosure to the subject for a time sufficient to prevent the hK2 expressing cancer.

The disclosure also provides a method of preventing a hK2 expressing cancer in a subject, comprising administering a therapeutically effective amount of the protein comprising the antigen biding domain that binds hK2 of the disclosure to the subject for a time sufficient to prevent the hK2 expressing cancer The disclosure also provides a method of preventing a hK2 expressing cancer in a subject, comprising administering a therapeutically effective amount of the multispecific protein comprising the antigen biding domain that binds hK2 of the disclosure to the subject for a time sufficient to prevent the hK2 expressing cancer.

The disclosure also provides a method of preventing a hK2 expressing cancer in a subject, comprising administering a therapeutically effective amount of the CAR comprising the antigen biding domain that binds hK2 of the disclosure to the subject for a time sufficient to prevent the hK2 expressing cancer.

The disclosure also provides a method of preventing a hK2 expressing cancer in a subject, comprising administering a therapeutically effective amount of the immunoconjugate comprising the antigen biding domain that binds hK2 of the disclosure to the subject for a time sufficient to prevent the hK2 expressing cancer.

The disclosure also provides a method of preventing a hK2 expressing cancer in a subject, comprising administering a therapeutically effective amount of the pharmaceutical composition comprising the antigen biding domain that binds hK2 of the disclosure to the subject for a time sufficient to prevent the hK2 expressing cancer.

The disclosure also provides a method of reducing the amount of hK2 expressing tumor cells in a subject, comprising administering the antigen biding domain that binds hK2 of the disclosure to the subject for a time sufficient to reduce the amount of hK2 expressing tumor cells.

The disclosure also provides a method of reducing the amount of hK2 expressing tumor cells in a subject, comprising administering the protein comprising the antigen biding domain that binds hK2 of the disclosure to the subject for a time sufficient to reduce the amount of hK2 expressing tumor cells.

The disclosure also provides a method of reducing the amount of hK2 expressing tumor cells in a subject, comprising administering the multispecific protein comprising the antigen biding domain that binds hK2 of the disclosure to the subject for a time sufficient to reduce the amount of hK2 expressing tumor cells.

The disclosure also provides a method of reducing the amount of hK2 expressing tumor cells in a subject, comprising administering the CAR that comprises the antigen biding domain that binds hK2 of the disclosure to the subject for a time sufficient to reduce the amount of hK2 expressing tumor cells.

The disclosure also provides a method of reducing the amount of hK2 expressing tumor cells in a subject, comprising administering the immunoconjugate of the disclosure to the subject for a time sufficient to reduce the amount of hK2 expressing tumor cells.

The disclosure also provides a method of reducing the amount of hK2 expressing tumor cells in a subject, comprising administering the pharmaceutical composition of the disclosure to the subject for a time sufficient to reduce the amount of hK2 expressing tumor cells.

In some embodiments, the hK2 expressing cancer is prostate cancer.

In some embodiments, the hK2 expressing cancer is prostate derived cancer.

In some embodiments, the hK2 expressing cancer has metastasized to bone.

In some embodiments, the hK2 expressing cancer is a breast cancer.

In some embodiments, the hK2 expressing cancer is an androgen receptor (AR) expressing breast cancer.

In some embodiments, the prostate cancer is relapsed, refractory, malignant or castration resistant prostate cancer, or any combination thereof.

In some embodiments, the breast cancer is relapsed, refractory or malignant breast cancer, or any combination thereof.

The disclosure also provides a method of treating prostate cancer in a subject, comprising administering a therapeutically effective amount of the multispecific protein comprising the antigen binding domain that binds hK2 to the subject for a time sufficient to treat the prostate cancer, wherein the antigen binding domain that bind hK2 comprises
the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169;
the VH of SEQ ID NO: 204 and the VL of SEQ ID NO: 205;
the VH of SEQ ID NO: 159 and the VL of SEQ ID NO: 160;
the VH of SEQ ID NO: 161 and the VL of SEQ ID NO: 140;
the VH of SEQ ID NO: 139 and the VL of SEQ ID NO: 140;
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 5 and the VL of SEQ ID NO: 1;
the VH of SEQ ID NO: 5 and the VL of SEQ ID NO: 3;
the VH of SEQ ID NO: 6 and the VL of SEQ ID NO: 1;
the VH of SEQ ID NO: 6 and the VL of SEQ ID NO: 2; or
the VH of SEQ ID NO: 6 and the VL of SEQ ID NO: 3.

The disclosure also provides a method of treating prostate cancer in a subject, comprising administering a therapeutically effective amount of the multispecific protein comprising the antigen binding domain that binds hK2 to the subject for a time sufficient to treat the prostate cancer, wherein the antigen binding domain that binds hK2 comprises the amino acid sequence of SEQ ID NOs: 8, 9, 10, 11, 12, 13, 14, 15, 16, 17, 18, 19, 20, 21, 22, 23, 133, 134, 135, 136, 308, 316, 318, 319, 320, 321, 322, 323, 324, 325, 404, 405, 406, 407, 408, or 409.

The disclosure also provides a method of treating breast cancer in a subject, comprising administering a therapeutically effective amount of the multispecific protein comprising the antigen binding domain that binds hK2 to the subject for a time sufficient to treat the breast cancer, wherein the antigen binding domain that bind hK2 comprises
the VH of SEQ ID NO: 137 and the VL of SEQ ID NO: 138;
the VH of SEQ ID NO: 162 and the VL of SEQ ID NO: 163;
the VH of SEQ ID NO: 164 and the VL of SEQ ID NO: 165;
the VH of SEQ ID NO: 166 and the VL of SEQ ID NO: 167;
the VH of SEQ ID NO: 168 and the VL of SEQ ID NO: 169;
the VH of SEQ ID NO: 204 and the VL of SEQ ID NO: 205;
the VH of SEQ ID NO: 159 and the VL of SEQ ID NO: 160;
the VH of SEQ ID NO: 161 and the VL of SEQ ID NO: 140;
the VH of SEQ ID NO: 139 and the VL of SEQ ID NO: 140;
the VH of SEQ ID NO: 4 and the VL of SEQ ID NO: 1;
the VH of SEQ ID NO: 4 and the VL of SEQ ID NO: 2;
the VH of SEQ ID NO: 4 and the VL of SEQ ID NO: 3;
the VH of SEQ ID NO: 5 and the VL of SEQ ID NO: 1;
the VH of SEQ ID NO: 5 and the VL of SEQ ID NO: 3;
the VH of SEQ ID NO: 6 and the VL of SEQ ID NO: 1;
the VH of SEQ ID NO: 6 and the VL of SEQ ID NO: 2; or
the VH of SEQ ID NO: 6 and the VL of SEQ ID NO: 3.

The disclosure also provides a method of treating breast cancer in a subject, comprising administering a therapeutically effective amount of the multispecific protein comprising the antigen binding domain that binds hK2 to the subject for a time sufficient to treat the breast cancer, wherein the antigen binding domain that binds hK2 comprises the amino acid sequence of SEQ ID NOs: 8, 9, 10, 11, 12, 13, 14, 15, 16, 17, 18, 19, 20, 21, 22, 23, 133, 134, 135, 136, 308, 316, 318, 319, 320, 321, 322, 323, 324, 325, 404, 405, 406, 407, 408, or 409.

The disclosure also provides a method of treating prostate cancer in a subject, comprising administering a therapeutically effective amount of the multispecific protein comprising the antigen binding domain that binds a lymphocyte antigen to the subject for a time sufficient to treat the prostate cancer, wherein the antigen binding domain that binds a lymphocyte antigen comprises: the HCDR1 of SEQ ID NO: 116, the HCDR2 of SEQ ID NO: 117, the HCDR3 of SEQ ID NO: 118, the LCDR1 of SEQ ID NO: 119, the LCDR2 of SEQ ID NO: 120 and the LCDR3 of SEQ ID NO: 121; the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and a LCDR3 of SEQ ID NO: 260; or the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

The disclosure also provides a method of treating prostate cancer in a subject, comprising administering a therapeutically effective amount of the multispecific protein comprising the antigen binding domain that binds a lymphocyte antigen to the subject for a time sufficient to treat the prostate cancer, wherein the antigen binding domain that binds a lymphocyte antigen comprises:
the VH of SEQ ID NO: 122 and the VL of SEQ ID NO: 123; or
the VH of SEQ ID NO: 248 and the VL of SEQ ID NO: 249; or
the VH of SEQ ID NO: 248 and the VL of SEQ ID NO: 250; or
the VH of SEQ ID NO: 248 and the VL of SEQ ID NO: 251; or
the VH of SEQ ID NO: 248 and the VL of SEQ ID NO: 252; or
the VH of SEQ ID NO: 248 and the VL of SEQ ID NO: 253; or
the VH of SEQ ID NO: 248 and the VL of SEQ ID NO: 254; or
the VH of SEQ ID NO: 248 and the VL of SEQ ID NO: 157.

The disclosure also provides a method of treating breast cancer in a subject, comprising administering a therapeutically effective amount of the multispecific protein comprising the antigen binding domain that binds a lymphocyte antigen to the subject for a time sufficient to treat the breast cancer, wherein the antigen binding domain that binds a lymphocyte antigen comprises: the HCDR1 of SEQ ID NO: 116, the HCDR2 of SEQ ID NO: 117, the HCDR3 of SEQ ID NO: 118, the LCDR1 of SEQ ID NO: 119, the LCDR2 of SEQ ID NO: 120 and the LCDR3 of SEQ ID NO: 121; the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and a LCDR3 of SEQ ID NO: 260; or the HCDR1 of SEQ ID NO: 255, the HCDR2 of SEQ ID NO: 256, the HCDR3 of SEQ ID NO: 257, the LCDR1 of SEQ ID NO: 258, the LCDR2 of SEQ ID NO: 259 and the LCDR3 of SEQ ID NO: 261.

The disclosure also provides a method of treating breast cancer in a subject, comprising administering a therapeutically effective amount of the multispecific protein comprising the antigen binding domain that binds a lymphocyte antigen to the subject for a time sufficient to treat the breast cancer, wherein the antigen binding domain that binds a lymphocyte antigen comprises:

the VH of SEQ ID NO: 122 and the VL of SEQ ID NO: 123; or
the VH of SEQ ID NO: 248 and the VL of SEQ ID NO: 249; or
the VH of SEQ ID NO: 248 and the VL of SEQ ID NO: 250; or
the VH of SEQ ID NO: 248 and the VL of SEQ ID NO: 251; or
the VH of SEQ ID NO: 248 and the VL of SEQ ID NO: 252; or
the VH of SEQ ID NO: 248 and the VL of SEQ ID NO: 253; or
the VH of SEQ ID NO: 248 and the VL of SEQ ID NO: 254; or
the VH of SEQ ID NO: 248 and the VL of SEQ ID NO: 157.

In one aspect, the present disclosure provides methods of preventing cancer, the methods comprising administering an amount of a lymphocyte expressing one or more of the CARs described to a subject in need thereof.

In one aspect, the present disclosure provides methods of treating a subject having cancer, the methods comprising administering a therapeutically effective amount of a lymphocyte expressing one or more of the CARs described to a subject in need thereof, whereby the lymphocyte induces or modulates killing of cancer cells in the subject.

In another aspect, the present disclosure provides methods of reducing tumor burden in a subject having cancer, the methods comprising administering a therapeutically effective amount of a lymphocyte expressing one or more of the CARs described herein to a subject in need thereof, whereby the lymphocyte induces killing of cancer cells in the subject. In another aspect, the present disclosure provides methods of increasing survival of a subject having cancer, the methods comprising administering a therapeutically effective amount of a lymphocyte expressing one or more of the CARs described to a subject in need thereof, whereby the survival of the subject is lengthened. Generally, the lymphocytes expressing the CAR(s) induce killing of cancer cells in the subject and result in reduction or eradication of the tumors/cancer cells in the subject. A non-limiting list of cancers, inclusive of metastatic lesions, that can be targeted, includes prostate cancer and breast cancer, and combinations thereof. In one embodiment, the cancer being treated in a subject is prostate cancer and breast cancer.

In one aspect, the methods described herein are applicable to treatment of noncancerous conditions that are at risk of developing into a cancerous condition, such as, e.g., enlarged prostate, and high PSA levels in absence of diagnosed prostate cancer.

In one aspect, methods of treating a subject having cancer are provided that comprise administering a therapeutically effective amount of a lymphocyte expressing a CAR, the CAR having an extracellular antigen-binding domain that binds the hK2 antigen, to a subject in need thereof, whereby the lymphocyte induces killing of cancer cells in the subject. In some embodiments, the at least one of the CARs comprises an amino acid sequence selected from the group consisting of SEQ ID NOS: 46-61.

In one aspect, a method of targeted killing of a cancer cell is disclosed, the method comprising contacting the cancer cell with a lymphocyte expressing one or more of the CARs described, whereby the lymphocyte induces killing of the cancer cell. A non-limiting list of cancer cells, inclusive of metastatic cancer cells, that can be targeted include prostate cancer, and combinations thereof. In one embodiment, the cancer cell is a prostate cancer cell.

When a therapeutically effective amount is indicated, the precise amount of the CARs or CAR-Ts of the present disclosure to be administered can be determined by a physician with consideration of individual differences in age, weight, tumor size, extent of infection or metastasis, and condition of the subject. It can generally be stated that a pharmaceutical composition comprising the T cells described herein may be administered at a dosage of about $10^4$ to about $10^{10}$ cells/kg body weight, in some instances about $10^5$ to about $10^6$ cells/kg body weight, including all integer values within those ranges. In some embodiments, a pharmaceutical composition comprising the T cells described herein may be administered at a dosage of about $10^6$ cells/kg body weight. T cell compositions may also be administered multiple times at these dosages. The cells can be administered by using infusion techniques that are commonly known in immunotherapy (see, e.g., Rosenberg et al., *New Eng. J. of Med.* 319:1676, 1988).

Delivery systems useful in the context of the CAR-T of the invention may include time-released, delayed release, and sustained release delivery systems such that the delivery of the T cell compositions occurs prior to, and with sufficient time to cause, sensitization of the site to be treated. The composition can be used in conjunction with other therapeutic agents or therapies. Such systems can avoid repeated administrations of the composition, thereby increasing convenience to the subject and the physician, and may be particularly suitable for certain composition embodiments of the invention.

Many types of release delivery systems are available and known to those of ordinary skill in the art. They include polymer base systems such as poly(lactide-glycolide), copolyoxalates, polyesteramides, polyorthoesters, polycaprolactones, polyhydroxybutyric acid, and polyanhydrides. Microcapsules of the foregoing polymers containing drugs are described in, for example, U.S. Pat. No. 5,075,109. Delivery systems also include non-polymer systems that are lipids including sterols such as cholesterol, cholesterol esters, and fatty acids or neutral fats such as mono-di- and tri-glycerides; sylastic systems: peptide based systems: hydrogel release systems: wax coatings; compressed tablets using conventional binders and excipients: partially fused implants; and the like. Specific examples include, but are not limited to: (a) erosional systems in which the active composition is contained in a form within a matrix such as those described in U.S. Pat. Nos. 4,452,775; 4,667,014; 4,748, 034; and 5,239,660 and (b) diffusional systems in which an active component permeates at a controlled rate from a polymer such as described in U.S. Pat. Nos. 3,854,480 and 3,832,253. In addition, pump-based hardware delivery systems can be used, some of which are adapted for implantation.

In certain aspects, it may be desirable to administer activated T cells to a subject and then subsequently redraw blood (or have an apheresis performed), activate the T cells according to the present disclosure, and reinfuse the subject with these activated and expanded T cells. This process can be carried out multiple times every few weeks. In certain aspects, T cells can be activated from blood draws of from 10 cc to 400 cc. In certain aspects, T cells are activated from blood draws of 20 cc, 30 cc, 40 cc, 50 cc, 60 cc, 70 cc, 80 cc, 90 cc, or 100 cc.

The administration of the CAR-T cells and compositions may be carried out in any manner, e.g., by parenteral or nonparenteral administration, including by aerosol inhalation, injection, infusions, ingestion, transfusion, implantation or transplantation. For example, the CAR-T cells and compositions described herein may be administered to a patient trans-arterially, intradermally, subcutaneously, intratumorally, intramedullary, intranodally, intramuscularly, by intravenous (i.v.) injection, or intraperitoneally. In one aspect, the compositions of the present disclosure are administered by i.v. injection. In one aspect, the compositions of the present disclosure are administered to a subject by intradermal or subcutaneous injection. The compositions of T cells may be injected, for instance, directly into a tumor, lymph node, tissue, organ, or site of infection.

Administration can be autologous or non-autologous. For example, immunoresponsive cells expressing a human Kallikrein-2 (e.g., hK2)-specific CAR can be obtained from one subject, and administered to the same subject or a different, compatible subject. Peripheral blood derived T cells of the present disclosure, or expanded T cells (e.g., in vivo, ex vivo or in vitro derived) can be administered via, e.g., intravenous injection, localized injection, systemic injection, catheter administration, or parenteral administration.

In particular embodiments, subjects may undergo leukapheresis, wherein leukocytes are collected, enriched, or depleted ex vivo to select and/or isolate the cells of interest, e.g., T cells. These T cell isolates may be expanded by methods known in the art and treated such that one or more CAR constructs of the present disclosure may be introduced, thereby creating a CAR-T cell. Subjects in need thereof may subsequently undergo standard treatment with high dose chemotherapy followed by peripheral blood stem cell transplantation. In certain aspects, following or concurrent with the transplant, subjects receive an infusion of the expanded CAR-T cells. In one aspect, expanded cells are administered before or following surgery.

The dosage administered to a patient having a malignancy is sufficient to alleviate or at least partially arrest the disease being treated ("therapeutically effective amount"). The dosage of the above treatments to be administered to a subject will vary with the precise nature of the condition being treated and the recipient of the treatment. The scaling of dosages for human administration can be performed according to practices generally accepted in the art.

The CART cells of the invention can undergo in vivo T cell expansion and can establish hK2-specific memory cells that persist at high levels for an extended amount of time in blood and bone marrow. In some instances, the CAR T cells of the invention infused into a subject can eliminate cancer cells, e.g., prostate cancer cells, in vivo in subjects with advanced chemotherapy-resistant cancer.

In one embodiment, a CAR of the present disclosure is introduced into T cells, e.g., using in vitro transcription, and the subject (e.g., human) receives an initial administration of CAR-T cells of the disclosure, and one or more subsequent administrations of the CAR-T cells, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR-T cells are administered to the subject (e.g., human) per week, e.g., 2, 3, or 4 administrations of the CAR-T cells are administered per week. In one embodiment, the subject receives more than one administration of the CAR-T cells per week (e.g., 2, 3 or 4 administrations per week) (also referred to herein as a cycle), followed by a week of no CAR-T cell administrations, and then one or more additional administration of the CAR-T cells (e.g., more than one administration of the CAR-T cells per week) is administered to the subject. In another embodiment, the subject receives more than one cycle of CAR-T cells, and the time between each cycle is less than 10, 9, 8, 7, 6, 5, 4, or 3 days. In one embodiment, the CAR-T cells are administered every other day for 3 administrations per week. In one embodiment, the CAR-T cells are administered for at least two, three, four, five, six, seven, eight or more weeks.

In one embodiment, administration may be repeated after one day, two days, three days, four days, five days, six days, one week, two weeks, three weeks, one month, five weeks, six weeks, seven weeks, two months, three months, four months, five months, six months or longer. Repeated courses of treatment are also possible, as is chronic administration. The repeated administration may be at the same dose or at a different dose.

The CAR-T cells may be administered in the methods of the invention by maintenance therapy, such as, e.g., once a week for a period of 6 months or more.

In one embodiment, CAR-T cells are generated using lentiviral viral vectors, such as lentivirus. CAR-T cells generated with such viral vectors will generally have stable CAR expression.

In one embodiment, CAR-T cells transiently express CAR vectors for 4, 5, 6, 7, 8, 9, 10, 11, 12, 13, 14, 15 days after transduction. Transient expression of CARs can be affected by RNA CAR vector delivery. In one embodiment, the CAR RNA is transduced into the T cell by electroporation.

If a patient is at high risk of generating an anti-CAR antibody response during the course of transient CAR therapy (such as those generated by RNA transductions). CAR-T infusion breaks should not last more than ten to fourteen days.

Combination Therapies

The hK2 binding proteins of the disclosure may be administered in combination with at least one additional therapeutics.

In some embodiments the at least one additional therapeutic is surgery, chemotherapy, androgen deprivation therapy or radiation, or any combination thereof.

In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

In one embodiment, other therapeutic agents such as factors may be administered before, after, or at the same time (simultaneous with) as the hK2 binding proteins such as CAR-T cells, including, but not limited to, interleukins, as well as colony stimulating factors, such as G-, M- and GM-CSF, and interferons.

The hK2 binding proteins such as CAR-expressing cell described herein and the at least one additional therapeutic agent can be administered simultaneously, in the same or in separate compositions, or sequentially. For sequential administration, the hK2 binding proteins such as CAR-expressing cell described herein can be administered first, and the additional agent can be administered second, or the order of administration can be reversed.

In further embodiments, the hK2 binding proteins such as CAR-expressing cells described herein may be used in a treatment regimen in combination with surgery, radiation, chemotherapy, immunosuppressive agents, antibodies, or other immunoablative agents. In another embodiment, the hK2 binding proteins such as CAR-expressing cell described herein can be used in combination with an anti-androgen treatment. In one embodiment, the subject can be administered an agent which enhances the activity of a CAR-expressing cell. For example, in one embodiment, the agent can be an agent which inhibits an inhibitory molecule.

Bispecific Embodiments

Provided below are embodiments of bispecific hk2/CD3 antibodies of the present invention.

KLCB91

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 255, 256, 275, 258, 259 and 261, respectively. According to an embodiment, the first binding domain that binds hK2 comprises a scFv of SEQ ID NO: 136, and the second binding domain that binds the lymphocyte antigen comprises the VH of SEQ ID NO: 248 and the VL of SEQ ID NO: 251. According to an embodiment, the isolated anti-hK2/anti-CD3 protein comprises a HC1 of SEQ ID NO: 351, a HC2 of SEQ ID NO: 358 and a LC2 of SEQ ID NO: 267.

KLCB105

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 63, 65, 66, 67, 69 and 71, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively. According to an embodiment, the first binding domain that binds hK2 comprises a scFv of SEQ ID NO: 136, and the second binding domain that binds the lymphocyte antigen comprises the VH of SEQ ID NO: 122 and the VL of SEQ ID NO: 123. According to an embodiment, the isolated anti-hK2/anti-CD3 protein comprises a HC1 of SEQ ID NO: 351, a HC2 of SEQ ID NO: 359 and a LC2 of SEQ ID NO: 272.

KLCB95

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively. According to an embodiment, the first binding domain that binds hK2 comprises a scFv of SEQ ID NO: 134, and the second binding domain that binds the lymphocyte antigen comprises the VH of SEQ ID NO: 248 and the VL of SEQ ID NO: 251. According to an embodiment, the isolated anti-hK2/anti-CD3 protein comprises a HC1 of SEQ ID NO: 352, a HC2 of SEQ ID NO: 358 and a LC2 of SEQ ID NO: 267.

KLCB96

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 141, 142, 143, 144, 145 and 146, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively. According to an embodiment, the first binding domain that binds hK2 comprises a scFv of SEQ ID NO: 134, and the second binding domain that binds the lymphocyte antigen comprises the VH of SEQ ID NO: 122 and the VL of SEQ ID NO: 123. According to an embodiment, the isolated anti-hK2/anti-CD3 protein comprises a HC1 of SEQ ID NO: 352, a HC2 of SEQ ID NO: 359 and a LC2 of SEQ ID NO: 272.

KLCB170

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively. According to an embodiment, the first binding domain that binds hK2 comprises a scFv of SEQ ID NO: 325, and the second binding domain that binds the lymphocyte antigen comprises the VH of SEQ ID NO: 248 and the VL of SEQ ID NO: 251. According to an embodiment, the isolated anti-hK2/anti-CD3 protein comprises a HC1 of SEQ ID NO: 353, a HC2 of SEQ ID NO: 358 and a LC2 of SEQ ID NO: 267.

KLCB80

According to an embodiment, an isolated anti-hK2/anti-CD3 protein comprises a first domain that binds hK2 and a second domain that binds CD3, wherein the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises a HCDR1, a HCDR2, a HCDR3, a LCDR1, a LCDR2 and a LCDR3 of SEQ ID NOs: 255, 256, 257, 258, 259 and 261, respectively. According to an embodiment, the first binding domain that binds hK2 comprises a VH of SEQ ID NO: 162 and a VL of SEQ ID NO: 163, and the second binding domain that binds the lymphocyte antigen comprises a scFv of SEQ ID NO: 331. According to an embodiment, the isolated anti-hK2/anti-CD3 protein comprises a HC1 of SEQ ID NO: 354, a LC1 of SEQ ID NO: 221 and a HC2 of SEQ ID NO: 360.

KLCB81

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 170, 183, 184, 185, 186 and 187, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively. According to an embodiment, the first binding domain that binds hK2 comprises a VH of SEQ ID NO: 166 and the VL of SEQ ID NO: 444, and the second binding domain that binds the lymphocyte antigen comprises a scFv of SEQ ID NO: 331. According to an embodiment, the isolated anti-hK2/anti-CD3 protein comprises a HC1 of SEQ ID NO: 355 a LC1 of SEQ ID NO: 223 and a HC2 of SEQ ID NO: 360.

KLCB113

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 176, 177, 178, 179, 180 and 181, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively. According to an embodiment, the first binding domain that binds hK2 comprises a VH of SEQ ID NO: 164 and the VL of SEQ ID NO: 165, and the second binding domain that binds the lymphocyte antigen comprises a scFv of SEQ ID NO: 331. According to an embodiment, the isolated anti-hK2/anti-CD3 protein comprises a HC1 of SEQ ID NO: 356, a LC1 of SEQ ID NO: 222 and a HC2 of SEQ ID NO: 360.

KLCB281

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 188, 189, 190, 191, 192 and 193, respectively, and the second domain that binds the lymphocyte antigen comprises the HCDR1, the HCDR2, the HCDR3, the LCDR1 the LCDR2 and the LCDR3 of SEQ ID NOs: 116, 117, 118, 119, 120 and 121, respectively. According to an embodiment, the first binding domain that binds hK2 comprises a scFv of SEQ ID NO: 325, and the second binding domain that binds the lymphocyte antigen comprises a VH of SEQ ID NO: 122 and a VL of SEQ ID NO: 123. According to an embodiment, the isolated anti-hK2/anti-CD3 protein comprises a HC1 of SEQ ID NO: 353, a HC2 of SEQ ID NO: 359 and a LC2 of SEQ ID NO: 272.

KLCB174

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 116, 117, 118, 119, 120 and 121, respectively. According to an embodiment, the first binding domain that binds hK2 comprises a scFv of SEQ ID NO: 316, and the second binding domain that binds the lymphocyte antigen comprises a VH of SEQ ID NO: 122 and a VL of SEQ ID NO: 123. According to an embodiment, the isolated anti-hK2/anti-CD3 protein comprises a HC1 of SEQ ID NO: 357, a HC2 of SEQ ID NO: 359 and a LC2 of SEQ ID NO: 272.

KLCB153

According to an embodiment, an isolated anti-hK2/anti-CD3 protein comprises a first domain that binds hK2 and a second domain that binds CD3, wherein the first binding domain that binds hK2 comprises a HCDR1, a HCDR2, a HCDR3, a LCDR1, a LCDR2 and a LCDR3 of SEQ ID NOs: 206, 207, 208, 182, 470, 209, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259, and 261, respectively. According to an embodiment, the first binding domain that binds hK2 comprises a scFv of SEQ ID NO: 316, and the second binding domain that binds the lymphocyte antigen comprises a VH of SEQ ID NO: 248 and a VL of SEQ ID NO: 151. According to an embodiment, the isolated anti-hK2/anti-CD3 protein comprises a HC1 of SEQ ID NO: 357, a HC2 of SEQ ID NO: 358 and a LC2 of SEQ ID NO: 267.

KLCB245

According to an embodiment, an isolated anti-hK2/anti-CD3 protein comprises a first domain that binds hK2 and a second domain that binds CD3, wherein The first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively. According to an embodiment, the first binding domain that binds hK2 comprises a VH of SEQ ID NO: 162 and the VL of SEQ ID NO: 163, and the second binding domain that binds the lymphocyte antigen comprises a scFv of SEQ ID NO: 331. According to an embodiment, the isolated anti-hK2/anti-CD3 protein comprises a HC1 of SEQ ID NO: 361, a LC1 of SEQ ID NO: 221 and a HC2 of SEQ ID NO: 362.

The following examples are provided to further describe some of the embodiments disclosed herein. The examples are intended to illustrate, not to limit, the disclosed embodiments.

Numbered Embodiments

The present disclosure also provides the following numbered embodiments:

1. An isolated protein comprising an antigen binding domain that binds kallikrein related peptidase 2 (hK2), wherein said antigen binding domain comprises the HCDR1, the HCDR1, the HCDR3, the LCDR1, the LCDR2 and the LCDR3 of SEQ ID NOs: 170, 171, 172, 173, 174 and 175, respectively.
2. The isolated protein of embodiment 1, wherein the antigen binding domain that binds hK2 comprises a VH which is at least 80% (e.g. at least 85%, at least 90%, at least 95%, at least 99% or 100%) identical to the VH of SEQ ID NO: 162.
3. The isolated protein of embodiment 2, wherein the antigen binding domain that binds hK2 comprises a VH of SEQ ID NO: 162.
4. The isolated protein of any one of embodiments 1-3, wherein the antigen binding domain that binds hK2 comprises a VL which is at least 80% (e.g. at least 85%, at least 90%, at least 95%, at least 99% or 100%) identical to the VL of SEQ ID NO: 163.
5. The isolated protein of embodiment 4, wherein the antigen binding domain that binds hK2 comprises a VL of SEQ ID NO: 163.
6. The isolated protein of any one of embodiments 1-5, wherein the antigen binding domain that binds hK2 is a Fab.
7. The isolated protein of any one of embodiments 1-6, wherein the protein is conjugated to a half-life extending moiety, wherein the half-life extending moiety is an immunoglobulin (Ig), a fragment of the Ig, an Ig constant region, or a fragment of the Ig constant region.
8. The isolated protein of embodiment 7, wherein the Ig constant region or the fragment of the Ig constant region comprises at least one mutation that results in reduced binding of the protein to a Fcγ receptor (FcγR), optionally wherein the mutations that results in reduced binding of the protein to the FcγR are L234A_L235A_D265S.
9. The isolated protein of embodiment 7 or 8, wherein the protein comprises at least one mutation in a CH3 domain of the Ig constant region, optionally wherein the mutations in the CH3 domain of the Ig constant region are T350V_T366L_K392L_T394W.
10. The isolated protein of any one of embodiments 7-9, wherein the IgG heavy chain constant region comprises an amino acid sequence which is at least 80% (e.g. at least 85%, at least 90%, at least 95%, at least 99% or 100%) identical to the amino acid sequence of SEQ ID NO: 378.
11. The isolated protein of embodiment 9, wherein the IgG heavy chain constant region comprises the amino acid sequence of SEQ ID NO: 378.
12. The isolated protein of any one of embodiments 7-11, wherein the IgG light chain constant region comprises an amino acid sequence which is at least 80% (e.g. at least 85%, at least 90%, at least 95%, at least 99% or 100%) identical to the amino acid sequence of SEQ ID NO: 309.
13. The isolated protein of embodiments 12, wherein the IgG light chain constant region comprises the amino acid sequence of SEQ ID NO: 309.
14. The isolated protein of any one of embodiments 1-13, wherein the isolated protein comprises a HC which is at least 80% (e.g. at least 85%, at least 90%, at least 95%, at least 99% or 100%) identical to SEQ ID NO: 354.
15. The isolated protein of embodiment 14, wherein the isolated protein comprises a HC of SEQ ID NO: 354.
16. The isolated protein of any one of embodiments 1-15, wherein the isolated protein comprises a LC which is at least 80% (e.g. at least 85%, at least 90%, at least 95%, at least 99% or 100%) identical to SEQ ID NO: 221.
17. The isolated protein of embodiment 16, wherein the isolated protein comprises a LC of SEQ ID NO: 221.
18. The isolated protein of any one of embodiments 1-17, wherein the isolated protein is a multispecific protein.
19. The isolated protein of embodiment 18, wherein the multispecific protein is a bispecific protein.
20. The multispecific protein of embodiment 18 or 19, comprising an antigen binding domain that binds an antigen on a lymphocyte.
21. The multispecific protein of embodiment 20, wherein the lymphocyte is a T cell.
22. The multispecific protein of embodiment 21, wherein the T cell is a $CD8^+$ T cell.
23. The multispecific protein of embodiment 22, wherein the lymphocyte is a natural killer (NK) cell.
24. The multispecific protein of any one of embodiments 20-23, wherein the antigen on the lymphocyte is CD3, CD3 epsilon (CD3ε), CD8, K12L4, NKG2E, NKG2D, NKG2F, BTNL3, CD186, BTNL8, PD-1, CD195, or NKG2C.
25. The multispecific protein of embodiment 24, wherein the wherein the antigen on the lymphocyte is CD3ε.
26. The multispecific protein of embodiment 25, wherein the antigen binding domain that binds CD3ε comprises
  a. a heavy chain complementarity determining region 1 (HCDR1) of SEQ ID NO: 116, a HCDR2 of SEQ ID NO: 117, a HCDR3 of SEQ ID NO: 118, a light chain complementarity determining region 1 (LCDR1) of SEQ ID NO: 119, a LCDR2 of SEQ ID NO: 120 and a LCDR3 of SEQ ID NO: 121; or
  b. the VH of SEQ ID NO: 122 and the VL of SEQ ID NO: 123.
27. The multispecific protein of embodiment 25, wherein the antigen binding domain that binds CD3ε comprises the VH of SEQ ID NO: 248 and the VL of SEQ ID NO: 157.
28. The multispecific protein of embodiment 25, wherein the antigen binding domain that binds CD3ε comprises
  a. a heavy chain complementarity determining region 1 (HCDR1) of SEQ ID NO: 255, a HCDR2 of SEQ ID NO: 256, a HCDR3 of SEQ ID NO: 257, a light chain complementarity determining region 1 (LCDR1) of SEQ ID NO: 258, a LCDR2 of SEQ ID NO: 259 and a LCDR3 of SEQ ID NO: 260; or
  b. the HCDR1 of SEQ ID NO: 255, a HCDR2 of SEQ ID NO: 256, a HCDR3 of SEQ ID NO: 257, a LCDR1 of SEQ ID NO: 258, a LCDR2 of SEQ ID NO: 259 and a LCDR3 of SEQ ID NO: 261; or
  c. the VH of SEQ ID NO: 248 and the VL of SEQ ID NO: 249; or
  d. the VH of SEQ ID NO: 248 and the VL of SEQ ID NO: 250; or
  e. the VH of SEQ ID NO: 248 and the VL of SEQ ID NO: 251; or
  f. the VH of SEQ ID NO: 248 and the VL of SEQ ID NO: 252; or
  g. the VH of SEQ ID NO: 248 and the VL of SEQ ID NO: 253; or
  h. the VH of SEQ ID NO: 248 and the VL of SEQ ID NO: 254.
29. The multispecific protein of any one of embodiments 25, wherein the antigen binding domain that binds CD3ε comprises a HCDR1 of SEQ ID NO: 255, a HCDR2 of SEQ ID NO: 256, a HCDR3 of SEQ ID NO: 257, a LCDR1 of SEQ ID NO: 258, a LCDR2 of SEQ ID NO: 259 and a LCDR3 of SEQ ID NO: 261.

30. The multispecific protein of embodiment 29, wherein the antigen binding domain that binds CD3ε comprises a VH which is at least 80% (e.g. at least 85%, at least 90%, at least 95%, at least 99% or 100%) identical to the VH of SEQ ID NO: 248.
31. The multispecific protein of embodiment 30, wherein the antigen binding domain that binds CD3ε comprises the VH of SEQ ID NO: 248.
32. The multispecific protein of any one of embodiments 29-31, wherein the antigen binding domain that binds CD3ε comprises a VL which is at least 80% (e.g. at least 85%, at least 90%, at least 95%, at least 99% or 100%) identical to the VL of SEQ ID NO: 251.
33. The multispecific protein of embodiment 32, wherein the antigen binding domain that binds CD3ε comprises the VL of SEQ ID NO: 251.
34. The multispecific protein of any one of embodiments 25-33, wherein the antigen binding domain that binds CD3ε is a scFv.
35. The multispecific protein of embodiment 34, wherein the scFv is at least 80% (e.g. at least 85%, at least 90%, at least 95%, at least 99% or 100%) identical to the scFv of SEQ ID NO: 331.
36. The multispecific protein of embodiment 35, wherein the scFv is the scFv of SEQ ID NO: 331.
37. The multispecific protein of any one of embodiments 25-36, wherein the antigen binding domain that binds an antigen on a lymphocyte is conjugated to a half-life extending moiety, wherein the half-life extending moiety is an immunoglobulin (Ig), a fragment of the Ig, an Ig constant region, or a fragment of the Ig constant region.
38. The multispecific protein of embodiment 37, wherein the Ig constant region or the fragment of the Ig constant region comprises at least one mutation that results in reduced binding of the protein to a Fcγ receptor (FcγR), optionally wherein the mutations that results in reduced binding of the protein to the FcγR are L234A_L235A_D265S.
39. The multispecific protein of embodiment 37 or 38, wherein the protein comprises at least one mutation in a CH3 domain of the Ig constant region, optionally wherein the mutations in the CH3 domain of the Ig constant region are T350V_L35Y_F405A_Y407V.
40. The multispecific protein of any one of embodiments 37-39, wherein the IgG constant region comprises an amino acid sequence which is at least 80% (e.g. at least 85%, at least 90%, at least 95%, at least 99% or 100%) identical to the amino acid sequence of SEQ ID NO: 109.
41. The multispecific protein of embodiment 40, wherein the IgG constant region comprises the amino acid sequence of SEQ ID NO: 109.
42. The multispecific protein of any one of embodiments 25-41, wherein the protein comprises an amino acid sequence which is at least 80% (e.g. at least 85%, at least 90%, at least 95%, at least 99% or 100%) identical to the amino acid sequence of SEQ ID NO: 360.
43. The multispecific protein of embodiment 42, wherein the protein comprises an amino acid sequence of SEQ ID NO: 360.
44. The multispecific protein of any one of embodiments 25-43, wherein the antigen binding domain binds CD3 within epitopes having sequences of SEQ ID NO: 341, 448, and 449.
45. An isolated anti-hK2/anti-CD3 protein, wherein the first binding domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds the lymphocyte antigen comprises the HCDR1, the HCDR2, the HCDR3, the LCDR1, the LCDR2 and the LCDR3 of SEQ ID NOs: 255, 256, 257, 258, 259 and 261, respectively.
46. The isolated anti-hK2/anti-CD3 protein of embodiment 45, wherein the first binding domain that binds hK2 comprises a VH which is at least 80% (e.g. at least 85%, at least 90%, at least 95%, at least 99% or 100%) identical to the VH of SEQ ID NO: 162.
47. The isolated anti-hK2/anti-CD3 protein of embodiment 46, wherein the first binding domain that binds hK2 comprises the VH of SEQ ID NO: 162.
48. The isolated anti-hK2/anti-CD3 protein of any one of embodiments 45-47, wherein the first binding domain that binds hK2 comprises a VL which is at least 80% (e.g. at least 85%, at least 90%, at least 95%, at least 99% or 100%) identical to the VL of SEQ ID NO: 163.
49. The isolated anti-hK2/anti-CD3 protein of embodiment 48, wherein the first binding domain that binds hK2 comprises the VL of SEQ ID NO: 163.
50. The isolated anti-hK2/anti-CD3 protein of any one of embodiments 4549, wherein the second binding domain that binds the lymphocyte antigen comprises a scFv which is at least 80% (e.g. at least 85%, at least 90%, at least 95%, at least 99% or 100%) identical to the scFv of SEQ ID NO: 331.
51. The isolated anti-hK2/anti-CD3 protein of embodiment 50, wherein the second binding domain that binds the lymphocyte antigen comprises the scFv of SEQ ID NO: 331.
52. The isolated anti-hK2/anti-CD3 protein of any one of embodiments 45-51, wherein the isolated multispecific protein comprises a HC1 which is at least 80% (e.g. at least 85%, at least 90%, at least 95%, at least 99% or 100%) identical to the HC1 of SEQ ID NO: 354.
53. The isolated anti-hK2/anti-CD3 protein of embodiment 52, wherein the isolated multispecific protein comprises the HC1 of SEQ ID NO: 354.
54. The isolated anti-hK2/anti-CD3 protein of any one of embodiments 45-53, wherein the isolated multispecific protein comprises a LC1 which is at least 80% (e.g. at least 85%, at least 90%, at least 95%, at least 99% or 100%) identical to the LC1 of SEQ ID NO: 221.
55. The isolated anti-hK2/anti-CD3 protein of embodiment 54, wherein the isolated multispecific protein comprises the LC1 of SEQ ID NO: 221.
56. The isolated anti-hK2/anti-CD3 protein of any one of embodiments 45-55, wherein the isolated multispecific protein comprises a HC2 which is at least 80% (e.g. at least 85%, at least 90%, at least 95%, at least 99% or 100%) identical to the HC2 of SEQ ID NO: 360.
57. The isolated anti-hK2/anti-CD3 protein of embodiment 56, wherein the isolated multispecific protein comprises the HC2 of SEQ ID NO: 360.
58. The isolated anti-hK2/anti-CD3 protein of any one of embodiments 52-57, wherein the isolated multispecific protein comprises a lysine (e.g. K477) at the C-terminus of HC1 and HC2.
59. The isolated anti-hK2/anti-CD3 protein of embodiment 58, wherein the isolated multispecific protein comprises a HC1 which comprises is at least 80% (e.g. at least 85%, at least 90%, at least 95%, at least 99% or 100%) identical to the HC1 of SEQ ID NO: 361.

60. The isolated anti-hK2/anti-CD3 protein of embodiment 59, wherein the isolated multispecific protein comprises the HC1 of SEQ ID NO: 361.
61. The isolated anti-hK2/anti-CD3 protein of any one of embodiments 58-60, wherein the isolated multispecific protein comprises a HC2 which is at least 80% (e.g. at least 85%, at least 90%, at least 95%, at least 99% or 100%) identical to the HC2 of SEQ ID NO: 362.
62. The isolated anti-hK2/anti-CD3 protein of embodiment 61, wherein the isolated multispecific protein comprises the HC2 of SEQ ID NO: 362.

EXAMPLES

Example 1. Generation of Anti-hK2 Antibodies and scFvs

Antibody Generation from Humanization of Parental m11B6 Antibody.

A parental mouse anti-HK2 antibody, m11B6 has been described in Väisänen et al (Clinical Chemistry 50:9, 1607-1617 (2004)). Humanized 11B6 (referred herein to as hu11B6) has been generated and described in U.S. Pat. Nos. 9,345,782 and 10,100,125.

Engineering of hu11B6 were initiated to generate additional anti-HK2 antibodies with improved properties, such as improved thermostability. Residue positions were identified in hu11B6 frameworks which could potentially be altered to improve thermostability of hu11B6 using modeling. The positions identified were residues P41, I49, M70, and A88 in the VH and S80, L82, A88 and Y91 in the VL (residue numbering according to the amino acid sequences of hu11B6_VH of SEQ ID NO: 5 and hu11B6_VL of SEQ ID NO: 2).

Binary combinatorial scFv libraries were generated in the orientation VH-linker-VL in which one of the variable regions represented the combinatorial library and the second one being the parental hu11B6 VH or VL. Linker sequence of GGSEGKSSGSGSESKSTGGS (SEQ ID NO: 7) was used to conjugate the VH/VL regions. The engineered scFvs were expressed in E coli and the produced scFvs in the supernatants were tested for binding to human hK2 by ELISA and compared to the binding of hu11B6. Any new variants exhibiting binding comparable to hu11B6 were consolidated and further tested for binding to human hK2 after incubation of the supernatants at 55° C., 60° C., and 65° C. for 10 minutes. The molecules which retained comparable binding to hu11B6 after incubation at 55° C., 60° C. and 65° C., and improved thermostability were matrixed in both orientations (VH-linker-VL; VL-linker-VH) and converted to mammalian scFvs for further characterization. The matrixed scFvs were also incorporated into CAR constructs and further characterized as further described in Example 11.

In addition, another humanization of parental mouse 11B6 was performed following the approach outlined by Singh et al (MAbs. 2015; 7(4):778-91), with extensive germ line variation and careful screening of the variants for enhanced thermal stability. Based on sequence conservation, the human heavy chain germline IGHV4-30 and the light chain germline IGKV3D-11, were chosen for framework adaption. A binary scFv library was constructed with residues comprising a select set of somatic hypermutation sites and mouse/human germline variations. The variants were cloned and expressed in E. coli as described above. The supernatants were screened at different temperatures in single point ELISA for enhanced thermal stability. A mouse/human chimeric 11B6 scFv was used as parental control. Clone KL2B359 which maintained binding activity similar to murine 11B6 and a Tm value of 67° C. was converted to scFv-Fc and CAR-T for additional profiling. Measured affinity ($K_D$) of KL2B359 to hK2 by SPR was ~0.7-1 nM. HCF3-LCD6, HCG5-LCB7, KL2B357, KL2B358 and KL2B360 also resulted from this campaign and were further characterized for functionality.

Antibody Generation Using Transgenic Mice (Ablexis®) and Transgenic Rats (OmniRat®) Expressing Human Immunoglobulin Loci.

The OmniRat® contains a chimeric human/rat IgH locus (comprising 22 human $V_H$S, all human D and $J_H$ segments in natural configuration linked to the rat $C_H$ locus) together with fully human IgL loci (12 Vκs linked to Jκ-Cκ and 16 Vλs linked to Jλ-Cλ). (see e.g., Osborn, et al. (2013) J Immunol 190(4): 1481-1490). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OmniRat®, and the genomic modifications carried by such rats, is described in WO14/093908.

Ablexis® mice generate antibodies having human variable domains linked to human CH1 and CL domains, chimeric human/mouse hinge region, and mouse Fc regions. Ablexis Kappa Mouse and Lambda Mouse strains are distinguished by which of their heavy chains are human or mouse as noted below. Antibodies produced by the Kappa Mouse lack sequence derived from mouse $V_H$, $D_H$ and $J_H$ exons and mouse Vκ, Jκ and Cκ exons. The endogenous mouse Igλ is active in the Kappa Mouse. The human Igκ chains comprise approximately 90-95% of the naïve repertoire and mouse Igλ chains comprise approximately 5-10% of the naïve repertoire in this strain. Antibodies produced by the Lambda Mouse lack sequence derived from mouse $V_H$, $D_H$ and $J_H$ exons and mouse Vλ, Jλ and Cλ exons. The endogenous mouse Igκ is active in the Lambda Mouse. The human Igλ chains comprise approximately 40% of the naïve repertoire and mouse Igκ chains comprise approximately 60% of the naïve repertoire. The preparation and use of Ablexis®, and the genomic modifications carried by such mice, is described in WO11/123708.

Ablexis mice and OmniRats rats were immunized with soluble full length KLK2 protein (human Kallikrein-2 6-His protein).

human Kallikrein-2 6-His protein (SEQ ID NO: 454)

VPLIEGRIVGGWECEKHSQPWQVAVYSHGWAHCGGVLVHPQWVLTAAHCL

KKNSQVWLGRHNLFEPEDTGQRVPVSHSFPHPLYNMSLLKHQSLRPDEDS

SHDLMLLRLSEPAKITDVVKVLGLPTQEPALGTTCYASGWGSIEPEEFLR

PRSLQCVSLHYSEKVTEFMLCAGLWTGGKDTCGGDSGGPLVCNGVLQGIT

SWGPEPCALPEKPAVYTKVVHYRKWIKDTIAANPHHHHHH

Lymphocytes from Ablexis mice and OniRats rats were extracted from lymph nodes and fusions performed by cohorts. Cells were combined and sorted for CD138 expression. Hybridoma screening was performed in high throughput miniaturized MSD format using soluble hK2 antigen. Approximately >300 samples were identified to be hK2 binders. The binding of >300 anti-hKLK2 supernatant samples to human KLK2 protein was measured by single cycle kinetics method by Biacore 8K SPR. Additionally the supernatant samples were tested for binding to human KLK3 protein as well. In parallel, supernatants were also tested for binding to KLK2 expressing cell lines VCap and negative cell line DU145 by Flow Cytometry. Selected cell binders were moved forward to scFv conversion in both VH-VL and VL/VH orientation and thermal stability tests as described above. KL2B413, KL2B30, KL2B53 and KL2B242 resulted from the Ablexis mice immunization campaign. KL2B467 and KL2B494 resulted from the OmniRat immunization campaign.

Antibodies generated through the various immunization and humanization campaigns described above were expressed in a fab format, a mAb format, a scFv format in the VH-linker-VL orientation or a scFv format in VL-linker-VH orientation and were further analyzed as described below. The linker sequence of SEQ ID NO: 7 described above was used to conjugate the VH/VL regions.

Example 2. Structural Characterization of Anti KLK2 Antibodies

Sequences of antibody variable domains and scFv antibody fragments which showed highest performance in intracellular assay are provided herein. Variable domains were expressed in a Fab format, a scFv format in the VH-linker-VL orientation or a scFv format in VL-linker-VH orientation.

Variable Domains VH, VL and CDRs

Table 3 shows the VH and VL amino acid sequences of selected anti-hK2 antibodies. Table 4 shows the Kabat HCDR1, HCDR2 and HCDR3 of selected anti-hK2 selected antibodies. Table 5 shows the Kabat LCDR1, LCDR2 and LCDR3 of the selected anti-hK2 antibodies. Table 6 shows the AbM HCDR1, HCDR2 and HCDR3 of selected anti-hK2 antibodies. Table 7 shows the AbM LCDR1, LCDR2 and LCDR3 of the anti-hK2. Table 8 summarizes the variable domain sequence and SEQ ID NO of selected hK2 antibodies. Table 9 shows the protein and DNA SEQ ID NOs for the VH and VL regions.

TABLE 3

VH and VL amino acid sequences of selected anti-hK2 antibodies.

| Ab name | VH name | VH amino acid Sequence | VH SEQ ID NO: | VL name | VL amino acid sequence | VL SEQ ID NO: |
|---|---|---|---|---|---|---|
| m11B6 | m11B6_VH | DVQLQESGPGLVKPSQSLSLTCTVTGNSITSDYAWNWIRQFPGNRLEWMGYISYSGSTTYSPSLKSRFSITRDTSKNQFFLQLNSVTPEDTATYFCATGYYYGSGFWGQGTLVTVSS | 125 | m11B6_VL | DIVLTQSPASLAVSLGQRATISCRASESVEYFGTSLMHWYRQKPGQPPKLLIYAASNVESGVPARFSGSGSGTDFSLNIQPVEEDDESMYFCQQTRKVPYTFGGGTKLEIK | 124 |
| h11B6 | hu11B6_VH | QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS | 5 | hu11B6_VL | DIVLTQSPDSLAVSLGERATINCKASESVEYFGTSLMHWYQQKPGQPPKLLIYAASNRESGVPDRFSGSGSGMFTLTISSLQAEDVAVYYCQQTRKVPYTFGQGTKLEIK | 2 |
| HCF3-LCD6 | HCF3_VH | QVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS | 6 | LCD6_VL | DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK | 1 |
| HCG5-LCB7 | HCG5_VH | QVQLQESGPGLVKPSDTLSLTCAVSGNSITSDYAWNWIRQFPGKGLEWMGYISYSGSTTYNP | 4 | LCB7_VL | DIVLTQSPDSLAVSLGERATINCKASESVEYFGTSLMHWYQQKPGQPPKLLIYAASNRESGVPDRFSGS | 3 |

TABLE 3-continued

VH and VL amino acid sequences of selected anti-hK2 antibodies.

| Ab name | VH name | VH amino acid Sequence | VH SEQ ID NO: | VL name | VL amino acid sequence | VL SEQ ID NO: |
|---|---|---|---|---|---|---|
| | | SLKSRVTISRDTSKNQFSLKLSSVTPVDTAVYYCATGYYYGSGFWGQGTLVTVSS | | | GSGTDFLTISSVQAEDVAVYYCQQTRKVPYTFGQGTKLEIK | |
| KL2B357 | KL2B357_VH | QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS | 159 | KL2B357_VL | DIVLTQSPDSLAVSLGERATINCRASESVEYFGTSLMHWYQQKPGQPPKLLIYAASNVESGVPDRFSGSGSGMFTLTISSLQAEDVAVYFCQQTRKVPYTEGGGTKVEIK | 160 |
| KL2B358 | KL2B358_VH | QVQLQESGPGLVPSQTLSLTCTVSGNTSDYAWNWIRQPPKGLEWIGYISYSGSTYNPSLKSRVTISRTSKNQFSLKLSSVTADTAVYYCATGYYGSGFWGQGTLVTSS | 161 | KL2B358_VL | EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK | 140 |
| KL2B359 | KL2B359_VH | QVQLQESGPGLVKPSQTLSLTCTVSGNSITSDYAWNWIRQFPGKRLEWIGYISYSGSTTYNPSLKSRVTISRDTSKNQFSLKLSSVTAACTAVYYCATGYYYGSGFWGQGTLVTVSS | 139 | KL2B359_VL | EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK | 140 |
| KL2B360 | KL2B360_VH | QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS | 159 | KL2B360_VL | EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTGGGTKVEIK | 140 |
| KL2B413 | KL2B413_VH | EVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSS | 137 | KL2B413_VL | EIVLTQSPSFLSASVGDRVTITCRASQGISSYLSWYQQKPGKAPKLLIYATSTLQSGVPSRESGSGSGTEFTLTISSLQPEDFATYYCQQLNSYPRTFGQGTKVEIK | 138 |
| KL2B30 | KL2B30_VH | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS | 162 | KL2B30_VL | DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK | 163 |

TABLE 3-continued

VH and VL amino acid sequences of selected anti-hK2 antibodies.

| Ab name | VH name | VH amino acid Sequence | VH SEQ ID NO: | VL name | VL amino acid sequence | VL SEQ ID NO: |
|---|---|---|---|---|---|---|
| KL2B53 | KL2B53_VH | EVQLVESGGGVVQPGRSLRLSCVASGFIFSSYDIHWVRQAPGKGLEWVAIISYDGSKIKDYTDSVKGRFTISRDNSKNTLYLQMDSLRVEDSAVYSCARESGWSHYYYGMDVWGQGTMVTVSS | 164 | KL2B53_VL | DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIK | 165 |
| KL2B242 | KL2B242_VH | QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSS | 166 | KL2B242_VL | SYELTQPPSVSNISTGETASITCSGDQLGENYACWYQQKPGQSPVLVIYQDSKRPSGIPERFSGSNSGNTATLTISGTQALDEADYYCQAWDNSIVVFGGCITKLIVL | 167 |
| KL2B467 | KL2B467_VH | QVQLVESGGGVVQPGRSLRLSCAASGFTFSYYGMHWVRQAPGKGLEWVAFISYDGSNKYYADSVKGRFTISRDNSKNTLYIQMNSLRAEDTAVYYCAHLPYSGSYWAFDYWGQGTQVTVSS | 168 | KL2B467_VL | QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTV | 169 |
| KL2B494 | KL2B494_VH | QVQLVESGGGLVQPGGSLRLSCAASGFTFSHYAMSWVRQAPGKGLEWVSTIGGSGGSTYYADSVKGRETISRDNSKNTLYLQMNSLRAEDTAVYYCAKPHIVNNTALLYDGMDVWGQGTMVTVSS | 204 | KL2B494_VL | SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL | 205 |
| KL2B242LC_C33S | KL2B242_VH | QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSS | 166 | KL2B242LC_C33S_VL | SYELTQPPSVSVSPGETASITCSGDQLGENYASWYQQKPGQSPVLVIYQDSKRPSGIPERTSGSNSGNTATLTISGTQALDEADYYCQAWDNSIVVFGGGTKLTVL | 444 |

TABLE 4

Kabat HCDR1, HCDR2 and HCDR3 amino acid sequences of selected anti-KLK2 antibodies.

| Ab name | Kabat HCDR1 Sequence | SEQ ID NO | Kabat HCDR2 Sequence | SEQ ID NO | Kabat HCDR3 Sequence | SEQ ID NO |
|---|---|---|---|---|---|---|
| m11B6 | SDYAWN | 63 | YISYSGSTTYSPSLKS | 64 | GYYYGSGF | 66 |
| hu11B6 | SDYAWN | 63 | YISYSGSTTYNPSLKS | 65 | GYYYGSGF | 66 |
| HCF3-LED6 | SDYAWN | 63 | YISYSGSTTYNPSLKS | 65 | GYYYGSGF | 66 |
| HCG5-LCB7 | SDYAWN | 63 | YISYSGSTTYNPSLKS | 65 | GYYYGSGF | 66 |
| KL2B357 | SDYAWN | 63 | YISYSGSTTYNPSLKS | 65 | GYYYGSGF | 66 |
| KL2B358 | SDYAWN | 63 | YISYSGSTTYNPSLKS | 65 | GYYYGSGF | 66 |
| KL2B359 | SDYAWN | 63 | YISYSGSTTYNPSLKS | 65 | GYYYGSGF | 66 |
| KL2B360 | SDYAWN | 63 | YISYSGSTTYNPSLKS | 65 | GYYYGSGF | 66 |
| KL2B413 | SYWMT | 141 | NIKQDGSERYYVDSVKG | 142 | DQNYDILTGHYGMDV | 143 |
| KL2B30 | SYYWS | 170 | YWYSGSTNYNPSLKS | 171 | TTIFGVVTPNFYYGMDV | 172 |
| KL2B53 | SYDIH | 176 | IISYDGSKKDYTDSVKG | 177 | ESGWSHYYYYGMDV | 178 |
| KL2B242 | SYYWS | 170 | RLYVSGFTNYNPSLKS | 183 | DSGNYWGWFDP | 184 |
| KL2B467 | YYGMH | 188 | FISYDGSNKYYADSVKG | 189 | LPYSGSYWAFDY | 190 |
| KL2B494 | HYAMS | 206 | TIGGSGGSTYYADSVKG | 207 | PHIVMVTALLYDGMDV | 208 |

TABLE 5

Kabat LCDR1, LCDR2 and LCDR3 amino acid sequences of selected anti-hK2 antibodies.

| Ab name | Kabat LCDR1 Sequence | SEQ ID NO | Kabat LCDR2 Sequence | SEQ ID NO | Kabat LCDR3 Sequence | SEQ ID NO |
|---|---|---|---|---|---|---|
| m11B6 | RASESVEYFGTSLMH | 67 | AASNVES | 69 | QQTRKVPYT | 71 |
| hu11B6 | KASESVEYFGTSLMH | 68 | AASNRES | 70 | QQTRKVPYT | 71 |
| HCF3-LCD6 | KASESVEYFGTSLMH | 68 | AASNRES | 70 | QQTRKVPYT | 71 |
| HCG5-LCB7 | KASESVEYFGTSLMH | 68 | AASNRES | 70 | QQTRKVPYT | 71 |
| KL2B357 | RASESVEYFGTSLMH | 67 | AASNVES | 69 | QQTRKVPYT | 71 |
| KL2B358 | RASESVEYFGTSLMH | 67 | AASNVES | 69 | QQTRKVPYT | 71 |
| KL2B359 | RASESVEYFGTSLMH | 67 | AASNVES | 69 | QQTRKVPYT | 71 |
| KL2B360 | RASESVEYFGTSLMH | 67 | AASNVES | 69 | QQTRKVPYT | 71 |
| KL2B413 | RASQGISSYLS | 144 | ATSTLQS | 145 | QQLNSYPRT | 146 |
| KL2B30 | RASQGISSYLA | 173 | AASTLQS | 174 | QQLNSYPLT | 175 |

TABLE 5-continued

Kabat LCDR1, LCDR2 and LCDR3 amino acid sequences of selected anti-hK2 antibodies.

| Ab name | Kabat LCDR1 Sequence | SEQ ID NO | Kabat LCDR2 Sequence | SEQ ID NO | Kabat LCDR3 Sequence | SEQ ID NO |
|---|---|---|---|---|---|---|
| KL2B53 | RASQDISNYLA | 179 | AASTLHS | 180 | QKYNSAPYT | 181 |
| KL2B242 | SGDQLGENYAC | 185 | QDSKRPS | 186 | QAWDNSIVV | 187 |
| KL2B467 | GGDNIGSKSVH | 191 | DNSDRPS | 192 | QVWDSSSDHPVV | 193 |
| KL2B494 | GGNNIGSKSVH | 182 | DDSDRPS | 470 | QVWDSSSDHVV | 209 |

TABLE 6

AbM HCDR1, HCDR2 and HCDR3 amino acid sequences of selected anti-hK2 antibodies.

| Ab name | AbM HCDR1 Sequence | SEQ ID NO | AbM HCDR2 Sequence | SEQ ID NO | AbM HCDR3 Sequence | SEQ ID NO |
|---|---|---|---|---|---|---|
| m11B6 | GNSITSDYAWN | 72 | YISYSGSTT | 73 | GYYYGSGF | 66 |
| hu11B6 | GNSITSDYAWN | 72 | YISYSGSTT | 73 | GYYYGSGF | 66 |
| FICT3-LCD6 | GNSITSDYAWN | 72 | YISYSGSTT | 73 | GYYYGSGF | 66 |
| FICG5-LCB7 | GNSITSDYAWN | 72 | YISYSGSTT | 73 | GYYYGSGF | 66 |
| KL2B357 | GNSITSDYAWN | 72 | YISYSGSTT | 73 | GYYYGSGF | 66 |
| KL2B358 | GNSITSDYAWN | 72 | YISYSGSTT | 73 | GYYYGSGF | 66 |
| KL2B359 | GNSITSDYAWN | 72 | YISYSGSTT | 73 | GYYYGSGF | 66 |
| KL2B360 | GNSITSDYAWN | 72 | YISYSGSTT | 73 | GYYYGSGF | 66 |
| KL2B413 | GFTSSYWMT | 147 | NIKQDGSERY | 148 | DQNYDILTGHYGMDV | 143 |
| KL2B30 | GGSISSYYWS | 194 | YIYYSGSTN | 195 | TTIFGVVTPNFYYGMDV | 172 |
| KL2B53 | GFTFSSYDIHD | 196 | IISYDGSKK | 197 | ESGWSHYYYYGMDV | 178 |
| KL2B242 | GGSISSYYWS | 198 | RLYVSGFTN | 199 | DSGNYWGWFDP | 184 |
| KL2B467 | GFTFSYY | 200 | FISYDGSNKY | 201 | LPYSGSYWAFDY | 190 |
| KL2B494 | GFTFSHYAMS | 216 | TIGGSGGSTYY | 217 | PHIVMVTALLYDGMDV | 218 |

TABLE 7

AbM LCDR1, LCDR2 and LCDR3 amino acid sequences of selected anti-hK2 antibodies.

| Ab name | AbM LCDR1 Sequence | SEQ ID NO | AbM LCDR2 Sequence | SEQ ID NO | AbM LCDR3 Sequence | SEQ ID NO |
|---|---|---|---|---|---|---|
| m11B6 | RASESVEYFGTSLMH | 67 | AASNVES | 69 | QQTRKVPYT | 71 |
| hu11B6 | KASESVEYFGTSLMH | 68 | AASNRES | 70 | QQTRKVPYT | 71 |
| HCF3-LCD6 | KASESVEYFGTSLMH | 68 | AASNRES | 70 | QQTRKVPYT | 71 |
| HCC15-LCB7 | KASESVEYFGTSLMH | 68 | AASNRES | 70 | QQTRKVPYT | 71 |
| KL2B357 | RASESVEYFGTSLMH | 67 | AASNVES | 69 | QQTRKVPYT | 71 |
| KL2B358 | RASESVEYFGTSLMH | 67 | AASNVES | 69 | QQTRKVPYT | 71 |
| KL2B359 | RASESVEYFGTSLMH | 67 | AASNVES | 69 | QQTRKVPYT | 71 |
| KL2B360 | RASESVEYFGTSLMH | 67 | AASNVES | 69 | QQTRKVPYT | 71 |
| KL2B413 | RASQGISSYLS | 144 | ATSTLQS | 145 | QQLNSYPRT | 146 |

TABLE 7-continued

AbM LCDR1, LCDR2 and LCDR3 amino acid sequences
of selected anti-hK2 antibodies.

| Ab name | AbM LCDR1 Sequence | SEQ ID NO | AbM LCDR2 Sequence | SEQ ID NO | AbM LCDR3 Sequence | SEQ ID NO |
|---|---|---|---|---|---|---|
| KL2B30 | RASQGISSYLA | 173 | AASTLQS | 174 | QQLNSYPLT | 175 |
| KL2B53 | RASQDISNYLA | 179 | AASTLHS | 180 | QKYNSAPYT | 181 |
| KL2B242 | SGDQLGENYAC | 185 | QDSKRPS | 186 | QAWDNSIVV | 187 |
| KL2B467 | GGDNIGSKSVH | 191 | DNSDRPS | 192 | QVWDSSSDHPVV | 193 |
| KL2B494 | GGNNIGSKSVH | 182 | DDSDRPS | 470 | QVWDSSSDHVV | 209 |

TABLE 8

Amino acid sequences and SEQ ID NO summary of the variable
domains of selected anti-hK2 antibodies

| Antibody name | Region | Amino acid sequence | SEQ ID NO: |
|---|---|---|---|
| m11B6 | HCDR1 | SDYAWN | 63 |
| | HCDR2 | YISYSGSTTYSPSLKS | 64 |
| | HCDR3 | GYYYGSGF | 66 |
| | LICDR1 | RASESVEYFGTSLMH | 67 |
| | LCDR2 | AASNVES | 69 |
| | LCDR3 | QQTRKVPYT | 71 |
| | VH (m11B6_VH) | DVQLQESGPGLVKPSQSLSLTCTVTGNSITSDYAWNWIRQFPGNRLEWMGYISYSGSTTYSPSLKSRFSITRDTSKNQFFLQLNSVTPEDTATYFCATGYYYGSGFWGQGTLVTVSS | 125 |
| | VL (m11B6_VL) | DIVLTQSPASLAVSLGQRATISCRASESVEYFGTSLMHWYRQKPGQPPKLLIYAASNVESGVPARFSGSGSGTDFSLNIQPVEEDDFSMYFCQQTRKVPYTFGGGTKLEIK | 124 |
| h11B6 | HCDR1 | SDYAWN | 63 |
| | HCDR2 | YISYSGSTTYNPSLKS | 65 |
| | HCDR3 | GYYYGSGF | 66 |
| | LICDRI | KASESVEYFGTSLMH | 68 |
| | LCDR2 | AASNRES | 70 |
| | LCDR3 | QQTRKVPYT | 71 |
| | VH (hu11B6_VH) | QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS | 5 |
| | VL (hu11B6_VL) | DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK | |
| HCF3-LCD6 | HCDR1 | SDYAWN | 63 |
| | HCDR2 | YISYSGSTTYNPSLKS | 65 |
| | HCDR3 | GYYYGSGF | 66 |
| | LICDR1 | KASESVEYFGTSLMH | 68 |
| | LCDR2 | AASNRES | 70 |
| | LCDR3 | QQTRKVPYT | 71 |
| | VH (HCF3_VH) | QVQLQESGPGLVKPSDTLSLTCAVSGNSITSDYAWNWIRQFPGKGLEWIGYISYSGSTTYNPSLKSRVTISRDTSKNQFSLKLSSVIPVDTAVYYCATGYYYGSGFWGQGTLVTVSS | 6 |
| | VL (LCD6_VL) | DIVLTQSPDSLAVSLGERATINCKASESVENTGTSLMHWYQQKPGQPPKKLLIYAASNRESGVPDRFSGSGSGTDFTLTIQSVQAEDVSVYFCQQTRKVPYTFGQGTKLEIK | 1 |

TABLE 8-continued

Amino acid sequences and SEQ ID NO summary of the variable
domains of selected anti-hK2 antibodies

| Antibody name | Region | Amino acid sequence | SEQ ID NO: |
|---|---|---|---|
| HCG5-LCB7 | HCDR1 | SDYAWN | 63 |
| | HCDR2 | YISYSGSTTYNPSLKS | 65 |
| | HCDR3 | GYYYGSGF | 66 |
| | LICDR1 | KASESVEYFGTSLMH | 68 |
| | LCDR2 | AASNRES | 70 |
| | LCDR3 | QQTRKVPYT | 71 |
| | VH (HCG5_VH) | QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS | 4 |
| | VL (LCB7_VL) | DIVLTQSPDSLAVSLGERATINCKASESVEYTGTSLMHWYQQKPGQPPKLLIYAASNRESGVPDRFSGSGSGTDFTLTISSVQAEDVAVYYCQQTRKVPYTFGQGTKLEIK | 3 |
| KL2B357 | HCDR1 | SDYAWN | 63 |
| | HCDR2 | YISYSGSTTYNPSLKS | 65 |
| | HCDR3 | GYYYGSGF | 66 |
| | LCDR1 | RASESVEYFGTSLMH | 67 |
| | LCDR2 | AASNVES | 69 |
| | LCDR3 | QQTRKVPYT | 71 |
| | VH (KL2B357_VH) | QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS | 159 |
| | VL (KL2B_357_VL) | DIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIK | 160 |
| KL2B358 | HCDR1 | SDYAWN | 63 |
| | HCDR2 | YISYSGSTTYNPSLKS | 65 |
| | HCDR3 | GYYYGSGF | 66 |
| | LICDR1 | RASESVEYFGTSMH | 67 |
| | LCDR2 | AASNVES | 69 |
| | LCDR3 | QQTRKVPYT | 71 |
| | VH (KL2B358_VH) | QVQLQESGPGLVKPSQTLSLTCTVSGNSITSDYAWNWTRQPPGKGLEWIGYISYSGSTTYNPSLKSRVTISRDTSKNQFSLKLSSVTAADTAVYYCATGYYYGSGFWGQGTLVTVSS | 161 |
| | VL (KL2B_358_VL) | EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK | 140 |
| KL2B359 | HCDR1 | SDYAWN | 63 |
| | HCDR2 | YISYSGSTTYNPSLKS | 65 |
| | HCDR3 | GYYYGSGF | 66 |
| | LICDR1 | RASESVEYFGTSLMH | 67 |
| | LCDR2 | AASNVES | 69 |
| | LCDR3 | QQTRKVPYT | 71 |
| | VH (KL2B359_VH) | QVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSS | 139 |
| | VL (KL213_359_VL) | EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK | 140 |
| KL2B360 | HCDRI | SDYAWN | 63 |
| | HCDR2 | YISYSGSTTYNPSLKS | 65 |
| | HCDR3 | GYYYGSGF | 66 |
| | LICDR1 | RASESVEYFGTSLMH | 67 |
| | LCDR2 | AASNVES | 69 |
| | LCDR3 | QQTRKVPYT | 71 |
| | VH (KL2B360_VH) | QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS | 159 |

TABLE 8-continued

Amino acid sequences and SEQ ID NO summary of the variable domains of selected anti-hK2 antibodies

| Antibody name | Region | Amino acid sequence | SEQ ID NO: |
|---|---|---|---|
| | VL (KL2B_360_VL) | EIVLTQSPATLSLSPGERATLSCRASESVEYFGTSLM HWYQQKPGQPPRLLIVAASNVESGIPARFSGSGSGT DFTLTISSVEPEDFAVYFCQQTRKVPYTFGGGTKVEI K | 140 |
| KL2B413 | HCDR1 | SYWMT | 141 |
| | HCDR2 | NIKQDGSERYYVDSVKG | 142 |
| | HCDR3 | DQNYDILTGHYGMDV | 143 |
| | LICDR1 | RASQGISSYLS | 144 |
| | LCDR2 | ATSTLQS | 145 |
| | LCDR3 | QQLNSYPRT | 146 |
| | VH (KL2B413_VH) | EVQLVESGGGLVQPGGSLRLSCAASGFTFSSYWMT WVRQAPGKGLEWVANIKQDGSERYYVDSVKGRFT ISRDNAKNSLYLQMNSLRAEDTAVYYCARDQNYDI LTGHYGMDVWGQGTTVTVSS | 137 |
| | VL (KL2B_413_VL) | EIVLTQSPSFLSASVGDRVTITCRASQGISSYLSWYQ QKPGKAPKLLIYATSTLQSGVPSRFSGSGSGTEFTLT ISSLQPEDFATYYCQQLNSYPRTFGQGTKVEIK | 138 |
| KL2B30 | HCDR1 | SYYWS | 170 |
| | HCDR2 | YIYYSGSTNYNPSLKS | 171 |
| | HCDR3 | TTIFGVVTPNFYYGMDV | 172 |
| | LICDR1 | RASQGISSYLA | 173 |
| | LCDR2 | AASTLQS | 174 |
| | LCDR3 | QQLNSYPLT | 175 |
| | VH (KL2B30_VH) | QVQLQESGPGLVKPSETLSLTCTVSGGSISSYYWSW IRQPPGKGLEWIGYIYYSGSTNYNPSLKSRVTISVDT SKNQFSLKLSSVTAADTAVYYCAGTTIFGVVTPNFY YGMDVWGQGTTVTVSS | 162 |
| | VL (KL2B30_VL) | DIQMTQSPSFLSASVGDRVTITCRASQGISSYLAWY QQKPGKAPKFLIYAASTLQSGVPSRFSGSGSGTEFTL TISSLQPEDFATYYCQQLNSYPLTFGGGTKVEIK | 163 |
| KL2B53 | HCDR1 | SYDIH | 176 |
| | HCDR2 | IISYDGSKKDYTDSVKG | 177 |
| | HCDR3 | ESGWSHYYYYGMDV | 178 |
| | LICDR1 | RASQDISNYLA | 179 |
| | LCDR2 | AASTLHS | 180 |
| | LCDR3 | QKYNSAPYT | 181 |
| | VH (KL2B53_VH) | EVQLVESGGGVVQPGRSLRLSCVASGFTFSSYDIHW VRQAPGKGLEWVAIISYDGSKKDYTDSVKGRFTISR DNSKNTLYLQMDSLRVED SAVYSCARESGWSHYYYYGMDVWGQGTMVTVSS | 164 |
| | VL (KL2B53_VL) | DIVMTQSPSSLSASVGDRVTITCRASQDISNYLAWY QQKPGKVPKFLIYAASTLHSGVPSRFSGSGSGTDFT LTISSLQPEDVATYYCQKYNSAPYTFGQGTRLEIK | 165 |
| KL2B242 | HCDR1 | SYYWS | 170 |
| | HCDR2 | RLYVSGFTNYNPSLKS | 183 |
| | HCDR3 | DSGNYWGWFDP | 184 |
| | LICDR1 | SGDQLGENYAC | 185 |
| | LCDR2 | QDSKRPS | 186 |
| | LCDR3 | QAWDNSIVV | 187 |
| | VH (KL2B242_VH) | QVQLQESGPGLVKPSETLSLTCTVSGGSISSYYWSW LRQPAGSGLEWIGRLYVSGFTNYNPSLKSRVTLSLD PSRNQLSLKLSSVTAADTAVYYCAGDSGNYWGWF DPWGQGTLVTVSS | 166 |
| | VL (KL2B242_VL) | SYELTQPPSVSVSPGETASITCSGDQLGENYACWYQ QKPGQSPVLVIYQDSKRPSGIPERFSGSNSGNTATLT ISGTQALDEADYYCQAWDNSIVVFGGGTKLTVL | 167 |

TABLE 8-continued

Amino acid sequences and SEQ ID NO summary of the variable domains of selected anti-hK2 antibodies

| Antibody name | Region | Amino acid sequence | SEQ ID NO: |
|---|---|---|---|
| KL2B467 | HCDR1 | YYGMH | 188 |
|  | HCDR2 | FISYDGSNKYYADSVKG | 189 |
|  | HCDR3 | LPYSGSYWAFDY | 190 |
|  | LlCDR1 | GGDNIGSKSVH | 191 |
|  | LCDR2 | DNSDRPS | 192 |
|  | LCDR3 | QVWDSSSDHPVV | 193 |
|  | VH (KL2B467_VH) | QVQLVESGGGVVQPGRSLRLSCAASGFTFSYYGMH WVRQAPGKGLEWVAFISYDGSNKYYADSVKGRFTI SRDNSKNTLYLQMNSLRAEDTAVYYCAHLPYSGSY WAFDYWGQGTQVTVSS | 168 |
|  | VL (KL2B467_VL) | QSVLTQPPSVSVAPGQTASITCGGDNIGSKSVHWYQ QKPGQAPVLVVYDNSDRPSGIPERFSGSNSGTTATL TISRVEAGDEADYYCQVWDSSSDHPVVFGGGTKVT V | 169 |
| KL2B494 | HCDR1 | HYAMS | 206 |
|  | HCDR2 | TIGGSGGSTYYADSVKG | 207 |
|  | HCDR3 | PHIVMVTALLYDGMDV | 208 |
|  | LCDR1 | GGNNIGSKSVH | 182 |
|  | LCDR2 | DDSDRPS | 470 |
|  | LCDR3 | QVWDSSSDHVV | 209 |
|  | VH (KL2B494_ VH) | QVQLVESGGGLVQPGGSLRLSCAASGFTFSHYAMS WVRQAPGKGLEWVSTIGGSGGSTYYADSVKGRFTI SRDNSKNTLYLQMNSLRAEDTAVYYCAKPHIVMV TALLYDGMDVWGQGTMVTVSS | 204 |
|  | VL (KL2B494_VL) | SSELTQPPSVSVAPGQTARITCGGNNIGSKSVHWYQ QKPGQAPVLVVYDDSDRPSGIPERFSGSNSGNTATL TISRVEAGDEADYYCQVWDSSSDHVVFGGGTKLTV L | 205 |

TABLE 9

SEQ ID NO of Protein and DNA sequences of the VH and VL domains of selected hK2 antibodies.

| Antibody | VH Protein SEQ ID NO: | VL Protein SEQ ID NO | VH cDNA SEQ ID NO: | VL cDNA SEQ ID NO: |
|---|---|---|---|---|
| m11B6 | 125 | 124 | 225 | 237 |
| hu11B6 | 5 | 2 | 226 | 238 |
| HCF3-LCD6 | 6 | 1 | 227 | 239 |
| HCG5-LCB7 | 4 | 3 | 228 | 240 |
| KL2B357 | 159 | 160 | 229 | 241 |
| KL2B358 | 161 | 140 | 230 | 242 |
| KL2B359 | 139 | 140 | 231 | 242 |
| KL2B360 | 159 | 140 | 229 | 242 |
| KL2B413 | 137 | 138 | 232 | 243 |
| KL2B30 | 162 | 163 | 233 | 244 |
| KL2B53 | 164 | 165 | 234 | 245 |
| KL2B242 | 166 | 167 | 235 | 246 |
| KL2B467 | 168 | 169 | 236 | 247 |
| KL2B494 | 204 | 205 | 263 | 271 |

(m11B6 VH cDNA)

SEQ ID NO: 225

GATGTGCAGCTTCAGGAGTCTGGACCCGGACTTGTTAAACCAAGTCAGTCTCTGTCCCTGAC

CTGTACCGTCACCGGCAACAGCATCACAAGCGATTACGCATGGAACTGGATCAGGCAGTTCC

CTGGAAATCGACTCGAATGGATGGGCTACATTTCATACTCCGGTTCAACCACTTACTCTCCAT

CCTTGAAATCTAGGTTCAGCATCACCCGTGATACCTCAAAGAACCAATTTTTTCTGCAACTG

AATAGCGTAACTCCAGAGGACACAGCCACATATTTCTGCGCCACTGGGTATTACTATGGCTC

AGGTTTCTGGGGTCAGGGCACTCTCGTCACCGTCAGCAGC (hu11B6 VH cDNA)

SEQ ID NO: 226

CAGGTCCAACTGCAAGAGAGCGGACCGGGCCTGGTAAAGCCATCCGACACATTGTCCCTGA

CGTGTGCGGTAAGTGGAAACTCTATCACTAGCGACTATGCGTGGAATTGGATAAGACAACC

-continued

GCCGGGCAAGGGGCTGGAATGGATAGGATATATCAGCTATTCCGGTTCTACGACATACAATC

CTTCCCTGAAAAGCAGAGTCACTATGTCACGCGACACGTCCAAGAATCAGTTCTCATTGAAA

TTGTCATCCGTAACGGCCGTTGACACTGCGGTTTATTATTGCGCAACCGGATATTACTACGGC

TCTGGTTTTTGGGGACAGGGAACACTTGTTACTGTTAGTTCA (HCF3-LCD6 VH cDNA)
SEQ ID NO: 227

CAGGTGCAGCTGCAGGAGAGCGGCCCAGGCCTGGTGAAGCCAAGCGACACCCTGAGCCTGA

CCTGCGCCGTGAGCGGCAACAGCATCACCAGCGACTACGCCTGGAACTGGATCCGCCAGTTC

CCAGGCAAGGGCCTGGAGTGGATCGGCTACATCAGCTACAGCGGCAGCACCACCTACAACC

CAAGCCTGAAGAGCCGCGTCACCATCAGCCGCGACACCAGCAAGAACCAGTTCAGCCTGAA

GCTGAGCAGCGTGACCCCTGTGGACACCGCCGTGTACTACTGCGCCACCGGCTACTACTACG

GCAGCGGCTTCTGGGGCCAGGGCACCCTGGTGACCGTGAGCAGC (HCG5-LCB7 VH cDNA)
SEQ ID NO: 228

CAGGTGCAGCTGCAGGAGAGCGGCCCAGGCCTGGTGAAGCCAAGCGACACCCTGAGCCTGA

CCTGCGCCGTGAGCGGCAACAGCATCACCAGCGACTACGCCTGGAACTGGATCCGCCAGTTC

CCAGGCAAGGGCCTGGAGTGGATGGGCTACATCAGCTACAGCGGCAGCACCACCTACAACC

CAAGCCTGAAGAGCCGCGTCACCATCAGCCGCGACACCAGCAAGAACCAGTTCAGCCTGAA

GCTGAGCAGCGTGACCCCTGTGGACACCGCCGTGTACTACTGCGCCACCGGCTACTACTACG

GCAGCGGCTTCTGGGGCCAGGGCACCCTGGTGACCGTGAGCAGC (KL2B357, KL2B360 VH cDNA)
SEQ ID NO: 229

CAGGTTCAGCTGCAAGAGTCTGGACCAGGCCTGGTCAAGCCCTCTCAGACCCTGTCTCTGAC

CTGTACCGTGTCCGGCAACTCCATCACCTCTGACTACGCCTGGAACTGGATTCGGCAGTTCC

CTGGCAAGGGCCTTGAGTGGATCGGCTACATCFCCTACTCCGGTTCCACCACCTACAACCCC

AGCCTGAAGTCCCGGGTCACCATCTCCCGCGACACCTCCAAGAACCAGTTCTCCCTGAAGCT

GTCCTCCGTGACCGCTGCTGATACCGCCGTGTACTACTGTGCCACCGGCTACTACTACGGCTC

CGGCTTTTGGGGACAGGGCACACTGGTTACCGTGTCTAGT (KL2B358 VH cDNA)
SEQ ID NO: 230

CAGGTTCAGCTGCAAGAGTCTGGACCAGGCCTGGTCAAGCCCTCTCAGACCCTGTCTCTGAC

CTGTACCGTGTCCGGCAACTCCATCACCTCTGACTACGCCTGGAACTGGATTCGGCAGCCAC

CTGGCAAGGGCCTTGAGTGGATCGGCTACATCFCCTACTCCGGTTCCACCACCTACAACCCC

AGCCTGAAGTCCCGGGTCACCATCTCCCGCGACACCTCCAAGAACCAGTTCTCCCTGAAGCT

GTCCTCCGTGACCGCTGCTGATACCGCCGTGTACTACTGTGCCACCGGCTACTACTACGGCTC

CGGCTTTTGGGGACAGGGCACACTGGTTACCGTGTCTAGT (KL2B359 VH cDNA)
SEQ ID NO: 231

CAGGTTCAGCTGCAAGAGTCTGGACCAGGCCTGGTCAAGCCCTCTCAGACCCTGTCTCTGAC

CTGTACCGTGTCCGGCAACTCCATCACCTCTGACTACGCCTGGAACTGGATTCGGCAGTTCC

CTGGCAAGCGCCTTGAGTGGATCGGCTACATCTCCTACTCCGGTTCCACCACCTACAACCCC

AGCCTGAAGTCCCGGGTCACCATCTCCCGCGACACCTCCAAGAACCAGTTCTCCCTGAAGCT

GTCCTCCGTGACCGCTGCTGATACCGCCGTGTACTACTGTGCCACCGGCTACTACTACGGCTC

CGGCTTTTGGGGACAGGGCACACTGGTTACCGTGTCTAGT

-continued (KL2B413 VH cDNA)
```
                                         SEQ ID NO: 232
GAGGTGCAACTTGTGGAGAGCGGCGGAGGTCTGGTCCAACCCGGAGGAAGTCTCCGTCTCT

CCTGTGCTGCTAGTGGCTTCACTTTCAGCTCATATTGGATGACATGGGTGAGACAAGCCCCA

GGAAAGGGGCTCGAGTGGGTAGCTAACATTAAACAGGACGGCTCCGAACGGTACTATGTTG

ATTCTGTGAAGGGACGMTCACTATATCCAGGGATAATGCAAAAAATTCACTCTATCTTCAA

ATGAACTCACTCAGAGCAGAGGACACTGCCGTGTATTATTGCGCCAGGGATCAAAATTATGA

CATACTGACCGGTCATTATGGAATGGATGTTTGGGGCCAGGGAACAACCGTTACCGTCTCAA

GT
```

(KL2B30 VH cDNA)
```
                                         SEQ ID NO: 233
CAGGTGCAGCTGCAGGAGTCGGGCCCAGGACTGGTGAAGCCTTCGGAGACCCTGTCCCTCA

CCTGCACTGTCTCTGGTGGCTCCATCAGTAGTTACTACTGGAGCTGGATCCGGCAGCCCCCA

GGGAAGGGACTGGAGTGGATTGGATATATCTATTACAGTGGGAGCACCAACTACAACCCCT

CCCTCAAGAGTCGAGTCACCATATCAGTAGACACGTCCAAGAACCAGTTCTCCCTGAAGCTG

AGCTCTGTGACCGCTGCGGACACGGCCGTGTATTACTGTGCGGGGACTACGATTTTTGGAGT

GGTTACCCCCAACTTCTACTACGGTATGGACGTCTGGGGCCAAGGGACCACGGTCACCGTCT

CCTCA
```

(KL2B53 VH cDNA)
```
                                         SEQ ID NO: 234
GAGGTGCAGCTGGTGGAGTCTGGGGGAGGCGTGGTCCAGCCTGGGAGGTCCCTGAGACTCT

CCTGTGTAGCCTCTGGATTCACCTTCAGTAGTTATGACATACACTGGGTCCGCCAGGCTCCA

GGCAAGGGGCTGGAGTGGGTGGCAATTATTTCATATGATGGAAGTAAAAAAGACTATACAG

ACTCCGTGAAGGGCCGATTCACCATCTCCAGAGACAATTCCAAGAACACGCTGTATCTGCAA

ATGGACAGCCTGAGAGTTGAGGACTCGGCTGTGTATTCCTGTGCGAGAGAAAGTGGCTGGTC

CCACTACTACTATTACGGTATGGACGTCTGGGGCCAAGGGACAATGGTCACCGTCTCTTCA
```

(KL2B242 VH cDNA)
```
                                         SEQ ID NO: 235
CAGGTGCAGCTGCAGGAGTCGGGCCCAGGACTGGTGAAGCCTTCGGAGACCCTGTCCCTCA

CCTGCACTGTCTCTGGTGGCTCCATCAGTAGTTACTATTGGAGCTGGCTCCGGCAGCCCGCC

GGGTCGGGACTGGAGTGGATTGGGCGTTTATATGTCAGTGGGTTCACCAACTACAACCCCTC

CCTCAAGAGTCGAGTCACCTTGTCACTAGACCCGTCCAGGAACCAGTTGTCCCTGAAACTGA

GTTCTGTGACCGCCGCGGACACGGCCGTATATTATTGTGCGGGAGATAGTGGGAACTACTGG

GGTTGGTTCGACCCCTGGGGCCAGGGAACCCTGGTCACCGTCTCCTCA
```

(KL2B467 VH cDNA)
```
                                         SEQ ID NO: 236
CAGGTGCAGCTGGTGGAGTCTGGGGGAGGCGTGGTCCAGCCTGGGAGGTCCCTGAGACTCT

CCTGTGCAGCCTCTGGATTCACCTTCAGTTACTATGGCATGCACTGGGTCCGCCAGGCTCCA

GGCAAGGGGCTGGAGTGGGTGGCATTTATATCATATGATGGAAGTAATAAATACTATGCAG

ACTCCGTGAAGGGCCGATTCACCATCTCCAGAGACAATTCCAAGAACACGCTGTATCTGCAA

ATGAACAGCCTGAGAGCTGAGGACACGGCTGTGTATTACTGTGCCCACCTCCCTTATAGTGG

GAGCTACTGGGCCTTTGACTACTGGGGCCAGGGAACCCAGGTCACCGTCTCTTCA
```

(KL2B494 VH cDNA)
```
                                         SEQ ID NO: 263
CAGGTGCAGCTGGTGGAGTCTGGGGGAGGCTTGGTACAGCCTGGGGGGTCCCTGAGACTCT

CCTGTGCAGCCTCTGGATTCACCTTTAGTCATTATGCCATGAGCTGGGTCCGCCAGGCTCCAG
```

-continued

```
GGAAGGGGCTGGAGTGGGTCTCAACTATTGGTGGTAGTGGTGGTAGCACATACTACGCAGA

CTCCGTGAAGGGCCGGTTCACCATCTCCAGAGACAATTCCAAGAACACGCTGTATCTGCAAA

TGAACAGCCTGAGAGCCGAGGACACGGCCGTATATTACTGTGCGAAACCTCATATTGTAATG

GTGACTGCTCTTCTCTACGACGGTATGGACGTCTGGGGCCAAGGGACAATGGTCACCGTCTC

CTCA
```

(m11B6 VL cDNA)

SEQ ID NO: 237

```
GACATTGTGCTGACACAGAGTCCAGCATCCTTGGCAGTATCTTTGGGGCAGCGGGCAACAAT

TTCATGCCGTGCATCTGAAAGTGTGGAGTATTTTGGAACTTCTCTTATGCACTGGTATCGCCA

GAAGCCTGGGCAGCCTCCCAAACTCCTTATATATGCCGCTTCCAACGTGGAGTCCGGAGTAC

CAGCACGCTTTTCCGGCTCTGGGTCCGGCACAGACTTTTCCCTCAATATCCAACCTGTTGAAG

AAGACGATTTTTCCATGTATTTTTGCCAACAGACACGCAAGGTTCCATATACATTCGGCGGC

GGCACTAAACTTGAGATCAAA
```

(hu11B6 VL cDNA)

SEQ ID NO: 238

```
GACATAGTCTTGACTCAGAGCCCGGATTCCCTTGCTGTGTCTCTGGGAGAACGAGCTACGAT

CAACTGCAAGGCAAGTGAATCCGTAGAATACTTCGGGACATCATTGATGCATTGGTATCAAC

AGAAACCGGGGCAACCGCCCAAATTGCTGATATATGCGGCTAGTAKTAGAGAATCAGGAGT

ACCGGATAGGTTTAGTGGTTCAGGATCAGGTACAGATTTCACCCTGACAATAAGTAGCTTGC

AAGCCGAAGACGTAGCAGTGTATTACTGCCAACAAACCCGAAAGGTGCCATATACGTTTGG

ACAGGGTACAAAGTTGGAAATCAAA
```

(HCF3-LCD6 VL cDNA)

SEQ ID NO: 239

```
GACATCGTGCTGACCCAGAGCCCAGACAGCCTGGCCGTGAGCCTGGGCGAGCGCGCCACCA

TCAACTGCAAGGCCAGCGAGAGCGTGGAGTACTTCGGCACCAGCCTGATGCACTGGTACCA

GCAGAAGCCAGGCCAGCCACCAAAGCTGCTGATCTACGCTGCCAGCAACCGCGAGAGCGGC

GTGCCAGACCGCTTCAGCGGCAGCGGCAGCGGCACCGACTTCACCCTGACCATCCAGAGCG

TGCAGGCCGAGGACGTCTCCGTGTACTTCTGCCAGCAGACCCGCAAGGTGCCATACACCTTC

GGCCAGGGCACCAAGCTGGAGATCAAG
```

(HCG5-LCB7 VL cDNA)

SEQ ID NO: 240

```
GACATCGTGCTGACCCAGAGCCCAGACAGCCTGGCCGTGAGCCTGGGCGAGCGCGCCACCA

TCAACTGCAAGGCCAGCGAGAGCGTGGAGTACTTCGGCACCAGCCTGATGCACTGGTACCA

GCAGAAGCCAGGCCAGCCACCAAAGCTGCTGATCTACGCTGCCAGCAACCGCGAGAGCGGC

GTGCCAGACCGCTTCAGCGGCAGCGGCAGCGGCACCGACTTCACCCTGACCATCAGCAGCG

TGCAGGCCGAGGACGTCGCCGTGTACTACTGCCAGCAGACCCGCAAGGTGCCATACACCTTC

GGCCAGGGCACCAAGCTGGAGATCAAG
```

(KL2B357 VL cDNA)

SEQ ID NO: 241

```
GACATCGTGCTGACCCAGTCTCCAGACTCTCTGGCTGTGTCTCTGGGCGAGAGAGCCACCAT

CAACTGCAGAGCCTCCGAGTCCGTGGAATACTTCGGCACCTCTCTGATGCACTGGTACCAGC

AGAAGCCCGGCCAGCCTCCTAAGCTGCTGATCTACGCCGCCTCCAACGTGGAATCTGGCGTG

CCCGATAGATTTTCCGGCTCTGGCTCTGGCACCGACTFTACCCTGACCATCAGCTCTCTGCAG

GCCGAGGATGTGGCCGTGTACTTCTGTCAGCAGACCCGGAAGGTGCCCTACACATTTGGCGG

CGGAACAAAGGTGGAAATCAAG
```

-continued (KL2B358, KL2B359, KL2B360 VL cDNA)
SEQ ID NO: 242
GAGATCGTGCTGACCCAGTCTCCTGCCACACTGTCACTGTCTCCAGGCGAGAGAGCCACCCT

CTCTTGTAGAGCCTCCGAGTCCGTGGAATACTTCGGCACCTCTCTGATGCACTGGTACCAGC

AGAAGCCCGGCCAGCCTCCTAGACTGCTGATCTACGCCGCCTCCAACGTCGAATCTGGCATC

CCCGCTAGATTCTCCGGCTCTGGCTCTGGCACAGACTTTACCCTGACCATCTCCTCCGTGGAA

CCCGAGGATTTCGCTGTGTACTTTTGCCAGCAGACCCGGAAGGTGCCCTACACATTTGGCGG

CGGAACAAAGGTGGAAATCAAG (KL2B413 VL cDNA)
SEQ ID NO: 243
GAAATCGTACTGACCCAGTCCCCTTCTTTCTTGAGTGCATCAGTTGGGGATAGAGTGACCAT

TACTTGTAGAGCATCTCAAGGTATTTCTTCATACTTGTCTTGGTATCAACAAAAACCTGGCAA

GGCACCCAAACTCTTGATCTACGCCACCTCTACATTGCAAAGTGGGGTTCCTTCTAGGTTTTC

AGGCTCCGGCTCTGGTACCGAGTTCACCCTCACTATAAGCAGTCTCCAACCTGAAGATTTCG

CTACTTATTATTGTCAGCAGCTTAATTCTTATCCCCGAACCTTTGGTCAAGGAACTAAGGTCG

AGATCAAA (KL2B30 VL cDNA)
SEQ ID NO: 244
GACATCCAGATGACCCAGTCTCCTTCCTTCCTGTCTGCATCTGTAGGAGACAGAGTCACCAT

CACTTGCCGGGCCAGTCAGGGCATTAGCAGTTATTTAGCCTGGTATCAGCAAAAACCAGGGA

AAGCCCCTAAGTTCCTGATCTATGCTGCATCCACTTTGCAAAGTGGGGTCCCATCAAGGTTC

AGCGGCAGTGGATCTGGGACAGAATTCACTCTCACAATCAGCAGCCTGCAGCCTGAAGATTT

TGCAACTTATTACTGTCAACAGMAATAGTTACCCTCTCACTTTCGGCGGAGGGACCAAGG

TGGAAATCAAA (KL2B53 VL cDNA)
SEQ ID NO: 245
GACATCGTGATGACCCAGTCTCCATCCTCCCTGTCTGCATCTGTAGGAGACAGAGTCACCAT

CACTTGCCGGGCGAGTCAGGACATTAGCAATTATTTAGCCTGGTATCAGCAGAAACCAGGG

AAAGTTCCTAAGTTCCTGATCTATGCTGCATCCACTTTGCACTCTGGGGTCCCATCTCGGTTC

AGTGGCAGTGGATCTGGGACAGATTTCACTCTCACCATCAGCAGCCTGCAGCCTGAAGATGT

TGCAACTTATTACTGTCAAAAGTATAACAGTGCCCCGTACACTTTTGGCCAAGGGACACGAC

TGGAGATTAAA (KL2B242 VL cDNA)
SEQ ID NO: 246
TCCTATGAGCTGACTCAGCCACCCTCAGTGTCCGTGTCCCCAGGAGAGACAGCCAGCATCAC

CTGCTCTGGAGATCAATTGGGGGAAAATTATGCTTGCTGGTATCAGCAGAAGCCAGGCCAGT

CCCCTGTGTTGGTCATCTATCAAGATAGTAAGCGGCCCTCAGGGATCCCTGAGCGATTCTCT

GGCTCCAACTCTGGGAACACAGCCACTCTGACCATCAGCGGGACCCAGGCTCTGGATGAGG

CTGACTATTACTGTCAGGCGTGGGACAACAGTATTGTGGTATTCGGCGGAGGGACCAAGCTG

ACCGTCCTA (KL2B467 VL cDNA)
SEQ ID NO: 247
CAGTCTGTGCTGACTCAGCCACCCTCGGTGTCAGTGGCCCCCGGGCAGACGGCCAGTATTAC

CTGTGGGGGAGACAACATTGGAAGTAAAAGTGTGCACTGGTACCAGCAGAAGCCAGGCCAG

GCCCCTGTGCTGGTCGTCTATGATAATAGCGACCGGCCCTCAGGGATCCCTGAGCGATTCTC

TGGCTCCAACTCTGGGACCACGGCCACCCTGACCATCAGCAGGGTCGAAGCCGGGGATGAG

```
                               -continued
GCCGACTATTACTGTCAGGTGTGGGATAGTAGTAGTGATCATCCTGTGGTATTCGGCGGAGG

GACCAAGGTCACCGTCCTA (KLK2B494_VL DNA)
                                                          SEQ ID: 271
TCTTCTGAGCTGACTCAGCCACCCTCGGTGTCAGTGGCCCCAGGACAGACGGCCAGGATTAC

CTGTGGGGAAACAACATTGGAAGTAAAAGTGTGCACTGGTACCAGCAGAAGCCAGGCCAG

GCCCCTGTGCTGGTCGTCTATGATGATAGCGACCGGCCCTCAGGGATCCCTGAGCGATTCTC

TGGCTCCAACTCTGGGAACACGGCCACCCTGACCATCAGCAGGGTCGAAGCCGGGGATGAG

GCCGACTATTACTGTCAGGTGTGGGATAGTAGTAGTGATCATGTGGTATTCGGCGGAGGGAC

CAAGCTGACCGTCCTA
```

Consensus VH and VL Sequences

FIG. 1 shows the sequence alignment of the VH domains of mu11B6, hu11B6, KL2B357, KL2B358, KL2B359, KL2B360, HCF3 and HCG5. FIG. 2 shows the sequence alignment of the VL domains of mu11B6, hu11B6, KL2B357, KL2B358, KL2B359, KL2B360, LDC6 and LCB7. Consensus amino acid sequence of SEQ ID NO: 75 and SEQ ID NO:74 were determined for the VH and VL domains, respectively. HCDR and LCDR residues are underlined.

SEQ ID NO: 75
QVQLQESGPGINKPSX$_1$TLSLTCX$_2$VSGNSITSDYAWNWIRQX$_3$PGKX$_4$L

EWX$_5$GYISYSGSTTYNPSLKSRVTX$_6$SRDTSKNQFSLKLSSVTX$_7$X$_8$DTA

VYYCATGYYYGSGFWGQGTLVTVSS wherein, $X_1$ is D or Q; $X_2$ is A or T; $X_3$ is P or F; $X_4$ is G or R; $X_5$ is I or M; $X_6$ is I or M; $X_7$ is A or P; or $X_8$ is V or A.

SEQ ID NO: 74
X$_1$IVLTQSPX$_2$X$_3$LX$_4$X$_5$SX$_6$GERATX$_7$X$_8$CX$_9$ASESVEYFGTSLMHWYQ

QKPGQPPX$_{10}$LLIYAASNX$_{11}$ESGX$_{12}$PX$_{13}$RFSGSGSGTDFTLTIX$_{14}$S

X$_{15}$X$_{16}$QX$_{17}$EDX$_{18}$X$_{19}$VYX$_{20}$CQQTRKVPYTFGX$_{21}$GTKX$_{22}$EIK wherein, $X_1$ is D or E; $X_2$ is D or A; $X_3$ is S or T; $X_4$ is A or S; $X_5$ is V or L; $X_6$ is L or P; $X_7$ is I or L; $X_8$ is N or S; $X_9$ is R or K; $X_{10}$ is K or R; $X_{11}$ is V or R; $X_{12}$ is V or I; $X_{13}$ is A or D; $X_{14}$ is Q or S; $X_{15}$ is L or V; $X_{16}$ is Q or E; $X_{17}$ is P or A; $X_{18}$ is F or V; $X_{19}$ is A or S; $X_{20}$ is Y or F; $X_{21}$ is Q or G; and $X_{22}$ is L or V Fab-Fc and scFvs The hK2 specific VH/VL regions were engineered as VH-CH1-hinge CH2-CH3 and VL-CL and expressed as IgG2 or IgG4 or were engineered as scFvs in either the VH-Linker-VL or VL-linker-VH orientations. The linker that is used in the scFv was the linker of SEQ ID NO: 7 described above. The scFv were used to generate bispecific antibodies as described in Example 7 or to generated CAR as described in Example 11.

Table 10 shows the HC amino acid sequences of selected anti-hK2 antibodies in the mAb format. Table 11 shows the LC amino acid sequences of selected anti-hK2 antibodies in a mAb. Table 12 summaries the HC and LC DNA SEQ ID NOs of selected anti-hK2 antibodies in the mAb format. Table 13 shows the amino acid sequences of selected scFvs in VH-linker-VL or VL-linker-VH orientation.

TABLE 10

Amino acid sequence of the HC (VH-CH1-hinge CH2-CH3) of selected anti-hK2 antibodies in a mAb format.

| HK2 HEAVY CHAIN | HC PROTEIN SEQ ID NO: | HC AMINO ACID SEQUENCE |
|---|---|---|
| m11B6_HC | 202 | DVQLQESGPGLVKPSQSLSUCTVTGNSITSDYAWNWIRQFP GNRLEWMGYISYSGSTTYSPSLKSRFSITRDTSKNQFFLQLNS VTPEDTATYFCATGYYYGSGFWGQGTLVTVSSAKTTAPSVY PLAPVCGDTTGSSVTLGCLVKGYFPEPVTLTWNSGSLSSGVH TFPAVLQSDLYTLSSSVTVTSSTWPSQSITCNVAHPASSTKVD KKIEPRGPTIKPCPPCKCPAPNLLGGPSVFIFPPKIKDVLMISLS PIVTCVVVDVSEDDPDVQISWFVNNVEVHTAQTQTHREDYN STLRVVSALPIQHQDWMSGKEFKCKVNNKDLPAPIERTISKP KGSVRAPQVYVLPPPEEEMTKKQVTLTCMVTDFMPEDIYVE WTNNGKTELNYKNTEPVLDSDGSYFMYSKLRVEKKNWVER NSYSCSVVHEGLHNHHTTKSFSRTPGK |
| h11B6_HC | 203 | QVQLQESGPGLVKPSDTLSLTCAVSGNSITSDYAWNWIRQPP GKGLEWIGYISYSGSTTYNPSLKSRVTMSRDTSKNQFSLKLSS VTAVDTAVYYCATGYYYGSGFWGQGTLVTVSSASTKGPSV FPLAPSSKSTSGGTAALGCLVKDYFPEPVTVSWNSGALTSGV HTFPAVLQSSGLYSLSSVVTVPSSSLGTQTYICNVNHKPSNTK |

TABLE 10-continued

Amino acid sequence of the HC (VH-CH1-hinge CH2-CH3) of selected anti-hK2 antibodies in a mAb format.

| HK2 HEAVY CHAIN | HC PROTEIN SEQ ID NO: | HC AMINO ACID SEQUENCE |
|---|---|---|
| | | VDKKVEPKSCDKTHTCPPCPAPELLGGPSVFLFPPKPKDTLMI SRTPEVTCVVVDVSHEDPEVKFNWYVDGVEVHNAKTKPRE EQYNSTYRVVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQ QGNVFSCSVMHEALHNHYTQKSLSLSPGK |
| KL2B30_HC | 210 | QVQLQESGPGLVKPSETLSLTCTVSGGSISSYYWSWIRQPPGK GLEWIGYIYYSGSTNYNPSLKSRVTISVDTSKNQFSLKLSSVT AADTAVYYCAGTTIFGVVTPNFYYGMDVWGQGTTVTVSSA STKGPSVFPLAPCSRSTSESTAALGCLVKDYFPEPVTVSWNSG ALTSGVHTFPAVLQSSGLYSLSSVVTVPSSSLGTKTYTCNVD HKPSNTKVDKRVESKYGPPCPPCPAPEAAGGPSVFLFPPKPK DTLMISRTPENTTCVVVDVSQEDPEVQFNWYVDGVEVHNAK TKPREEQFNSTYRVVSVLTVLHQDWLNGKEYKCKVSNKGLP SSIEKTISKAKGQPREPQVYTLPPSQEEMTKNQVSLTCLVKGF YPSDIAVEWESNGQPENNYKTTPPVLDSDGSFFLYSRLTVDK SRWQEGNVFSCSVMHEALHNHYTQKSLSLSLGK |
| K2B53_HC | 211 | EVQLVESGGGVVQPGRSLRLSCVASGFTFSSYDIHWVRQAPG KGLEWVAIISYDGSKKDYTDSVKGRFTISRDNSKNTLYLQM DSLRVEDSAVYSCARESGWSHYYYYGMDVWGQGTMVTVS SASTKGPSVFPLAPCSRSTSESTAALGCLVKDYFPEPVTVSWN SGALTSGVHTFPAVLQSSGLYSLSSVVTVPSSSLGTKTYTCNV DHKPSNTKVDKRVESKYGPPCPPCPAPEAAGGPSVFLFPPKP KDTLMISRTPEVTCVVVDVSQEDPEVQFNWYVDGVENVHNA KTKPREEQFNSTYRVVSVLTVLHQDWLNGKEYKCKVSNKG LPSSIEKTISKAKGQPREPQVYTLPPSQEEMTKNQVSLTCLVK GFYPSDIAVEWESNGQPENNYKTTPPVLDSDGSFFLYSRLTV DKSRWQEGNVFSCSVMHEALHNHYTQKSLSLSLGK |
| KL2B242_HC | 212 | QVQLQESGPGLVKPSETLSLTCTVSGGSISSYYWSWLRQPAG SGLEWIGRLYVSGFTNYNPSLKSRVTLSLDPSRNQLSLKLSSV TAADTAVYYCAGDSGNYWGWFDPWGQGTLVTNSSASTKG PSVFPLAPCSRSTSESTAALGCLVKDYFPEPVTVSWNSGALTS GVHTFPAVLQSSGLYSLSSVVTVPSSSLGTKTYTCNVDHKPS NTKVDKRVESKYGPPCPPCPAPEAAGGPSVFLFPPKPKDTLM ISRTPEVTCVVVDVSQEDPEVQFNWYVDGVEVHNAKTKPRE EQFNSTYRVVSVLTVLHQDWLNGKEYKCKVSNKGLPSSIEK TISKAKGQPREPQVYTLPPSQEEMTKNQVSLTCLVKGFYPSDI AVEWESNGQPENNYKTTPPVLDSDGSFFLYSRLTVDKSRWQ EGNVFSCSVMHEALHNHYTQKSLSLSLGK |
| KL2B467_HC | 213 | QVQLVESGGGVVQPGRSLRLSCAASGFTFSYYGMHWVRQA PGKGLEWVAFISYDGSNKYYADSVKGRFTISRDNSKNTLYL QMNSLRAEDTAVYYCAHLPYSGSYWAFDYWGQGTQVTVSS ASTKGPSVFPLAPSSKSTSGGTAALGCLVKDYFPEPVTVSWN SGALTSGVHTFPAVLQSSGLYSLSSVVTVPSSSLGTQTYICNV NHKPSNTKVDKKVEPKSCDKTHTCPPCPAPEAAGGPSVFLFP PKPKDTLMISRTPEVTCVVVSVSHEDPEVKFNWYVDGVEVH NAKTKPREEQYNSTYRVVSVLTVLHQDWLNGKEYKCKVSN KALPAPIEKTISKAKGQPREPQVYTLPPSREEMTKNQVSLTCL VKGFYPSDIAVEWESNGQPENNYKTTPPVLDSDGSFFLYSKL TVDKSRWQQGNVFSCSVMHEALHNHYTQKSLSLSPGK |
| KL2B494_HC | 219 | QVQLVESGGGLVQPGGSLRLSCAASGFTFSHYAMSWVRQAP GKGLEWVSTIGGSGGSTYYADSVKGRFTISRDNSKNTLYLQ MNSLRAEDTAVYYCAKPHIVMVTALLYDGMDVWGQGTMV TVSSASTKGPSVFPLAPSSKSTSGGTAALGCLVKDYFPEPVTV SWNSGALTSGVHTFPAVLQSSGLYSLSSVVTNPSSSLGTQTYI CNVNHKPSNTKVDKKVEPKSCDKTHTCPPCPAPEAAGGPSV FLFPPKPKDTLMISRTPEVTCVVVSVSHEDPEVKFNWYVDGV EVHNAKTKPREEQYNSTYRVVSVLTVLHQDWLNGKEYKCK VSNKALPAPIEKTISKAKGQPREPQVYTLPPSREEMTKNQVSL TCLVKGFYPSDIAVEWESNGQPENNYKTTPPVLDSDGSFFLY SKLTVDKSRWQQGNVFSCSVMHEALHNHYTQKSLSLSPGK |

TABLE 11

Amino acid sequences of the LC (VL-CL) of selected anti-hK2 antibodies in a mAb (Fab-Fc) format.

| HK2 LIGHT CHAIN | LC PROTEIN SEQ ID NO: | LC AMINO ACID SEQUENCE |
|---|---|---|
| m11B6_LC | 214 | DIVLTQSPASLAVSLGQRATISCRASESVEYFGTSLMHWYRQKPGQP PKLLIYAASNVESGVPARFSGSGSGTDFSLNIQPVEEDDFSMYFCQQ TRKVPYTFGGGTKLEIKRADAAPTVSIFPPSSEQLTSGGASVVCFLN NFYPKDINVKWKIDGSERQNGVLNSWTDQDSKDSTYSMSSTLTLTK DEYERHNSYTCEATHKTSTSPIVKSFNRNEC |
| h11B6_LC | 215 | DIVLTQSPDSLAVSLGERATINCKASESVEYFGTSLMHWYQQKPGQ PPKLLIYAASNRESGVPDRFSGSGSGTDFTLTISSLQAEDVAVYYCQ QTRKVPYTFGQGTKLEIKRTVAAPSVFIFPPSDEQLKSGTASVVCLL NNFYPREAKVQWKVDNALQSGNSQESVTEQDSKDSTYSLSSTLTLS KADYEKEKVYACEVTHQGLSSPVTKSFNRGEC |
| KL2B30_LC | 221 | DIQMTQSPSFLSASVGDRVTITCRASQGISSYLAWYQQKPGKAPKFL IYAASTQSGVPSRFSGSGSGTEFTLTISSLQPEDFATYYCQQLNSYP LTFGGGTKVEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| KL2B53_LC | 222 | DIVMTQSPSSLSASVGDRVTITCRASQDISNYLAWYQQKPGKVPKFL IYAASTLHSGVPSRFSGSGSGTDFTLTISSLQPEDVATYYCQKYNSAP YTFGQGTRLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| KL2B242_LC | 223 | SYELTQPPSVSVSTGETASITCSGDQLGENYACWYQQKPGQSPVLVI YQDSKRPSGIPERFSGSNSGNTATLTISGTQALDEADYYCQAWDNSI VVFGGGTKLTVLGQPKAAPSVTLFPPSSEELQANKATLVCLISDFYP GAVTVAWKADSSPVKAGVETTTPSKQSNNKYAASSYLSLTPEQWK SHRSYSCQVTHEGSTVEKTVAPTECS |
| KL2B467_LC | 224 | QSVLTQPPSVSVAPGQTASITCGGDNIGSKSVHWYQQKPGQAPVLV VYDNSDRPSGIPERFSGSNSGTTAILTISRVEAGDEADYYCQVWDSS SDHPVVFGGGTKVTVLGQPKAAPSVTLFPPSSEELQANKATLVCLIS DFYPGAVTVAWKADSSPVKAGVETTTPSKQSNNKYAASSYLSLTPE QWKSHRSYSCQVTHEGSTVEKTVAPTECS |
| KL2B494_LC | 220 | SSELTQPPSVSVAPGQTARITCGGNNIGSKSVHWYQQKPGQAPVLV VYDDSDRPSGIPERFSGSNSGNTATLTISRVEAGDEADYYCQVWDS SSDHVVFGGGTKLTVLGQPKAAPSVTLFPPSSEELQANKATLVCLIS DFYPGAVTVAWKADSSPVKAGVETTTPSKQSNNKYAASSYLSLTPE QWKSHRSYSCQVTHEGSTVEKTVAPTECS |

TABLE 12

SEQ ID Nos of the cDNA sequences of HC and LC of selected hK2 antibodies

| Antibody | HC Protein SEQ ID NO: | LC Protein SEQ ID NO: | HC cDNA SEQ ID NO: | LC cDNA SEQ ID NO: |
|---|---|---|---|---|
| m11B6 | 202 | 214 | 284 | 296 |
| hu11B6 | 203 | 215 | 285 | 297 |
| KL2B30 | 210 | 221 | 292 | 450 |
| KL2B53 | 211 | 222 | 293 | 451 |
| KL2B242 | 212 | 223 | 294 | 305 |
| KL2B467 | 213 | 224 | 295 | 306 |
| KL2B494 | 219 | 220 | 274 | 282 |

(M11B6 HC cDNA)

SEQ ID NO: 284
GATGTGCAGCTTCAGGAGTCTGGACCCGGACTTGTTAAACCAAGTCAGTCTCTGTCCCTGAC

CTGTACCGTCACCGGCAACAGCATCACAAGCGATTACGCATGGAACTGGATCAGGCAGTTCC

CTGGAAATCGACTCGAATGGATGGGCTACATTTCATACTCCGGTTCAACCACTTACTCTCCAT

CCTTGAAATCTAGGTTCAGCATCACCCGTGATACCTCAAAGAACCAATTTTTTCTGCAACTG

AATAGCGTAACTCCAGAGGACACAGCCACATATTTCTGCGCCACTGGGTATTACTATGGCTC

-continued

AGGTTTCTGGGGTCAGGGCACTCTCGTCACCGTCAGCAGCGCCAAAACAACAGCACCAAGT

GTCTATCCACTGGCCCCTGTGTGTGGAGATACAACTGGCTCCTCGGTGACTCTAGGATGCCT

GGTCAAGGGTTATTTCCCTGAGCCAGTGACCTTGACCTGGAACTCTGGATCCCTGTCCAGTG

GTGTGCACACCTTCCCAGCTGTCCTGCAGTCTGACCTCTACACCCTCAGCAGCTCAGTGACTG

TAACCTCGAGCACCTGGCCCAGCCAGTCCATCACCTGCAATGTGGCCCACCCGGCAAGCAGC

ACCAAGGTGGACAAGAAAATTGAGCCCAGAGGGCCCACAATCAAGCCCTGTCCTCCATGCA

AATGCCCAGCACCTAACCTCTTGGGTGGACCATCCGTCTTCATCTTCCCTCCAAAGATCAAG

GATGTACTCATGATCTCCCTGAGCCCCATAGTCACATGTGTGGTGGTGGATGTGAGCGAGGA

TGACCCAGATGTCCAGATCAGCTGGTTTGTGAACAACGTGGAAGTACACACAGCTCAGACA

CAAACCCATAGAGAGGATTACAACAGTACTCTCCGGGTGGTCAGTGCCCTCCCCATCCAGCA

CCAGGACTGGATGAGTGGCAAGGAGTTCAAATGCAAGGTCAACAACAAAGACCTCCCAGCG

CCCATCGAGAGAACCATCTCAAAACCCAAAGGGTCAGTAAGAGCTCCACAGGTATATGTCTT

GCCTCCACCAGAAGAAGAGATGACTAAGAAACAGGTCACTCTGACCTGCATGGTCACCGAC

TTCATGCCTGAAGACATTTACGTGGAGTGGACCAACAACGGGAAAACAGAGCTAAACTACA

AGAACACTGAACCAGTCCTGGACTCTGATGGTTCTTACTTCATGTACAGCAAGCTGAGAGTG

GAAAAGAAGAACTGGGTGGAAAGAAATAGCTACTCCTGTTCAGTGGTCCACGAGGGTCTGC

ACAATCACCACACGACTAAGAGCTTCTCCCGGACTCCGGGTAAA (hu11B6 HC cDNA)

SEQ ID NO: 285

CAGGTCCAACTGCAAGAGAGCGGACCGGGCCTGGTAAAGCCATCCGACACATTGTCCCTGA

CGTGTGCGGTAAGTGGAAACTCTATCACTAGCGACTATGCGTGGAATTGGATAAGACAACC

GCCGGGCAAGGGGCTGGAATGGATAGGATATATCAGCTATTCCGGTTCTACGACATACAATC

CTTCCCTGAAAAGCAGAGTCACTATGTCACGCGACACGTCCAAGAATCAGTTCTCATTGAAA

TTGTCATCCGTAACGGCCGTTGACACTGCGGTTTATTATTGCGCAACCGGATATTACTACGGC

TCTGGTTTTTGGGGACAGGGAACACTTGTTACTGTTAGTTCAGCCTCCACCAAGGGCCCATC

GGTCTTCCCCCTGGCACCCTCCTCCAAGAGCACCTCTGGGGGCACAGCGGCCCTGGGCTGCC

TGGTCAAGGACTACTTCCCCGAACCGGTGACGGTGTCGTGGAACTCAGGCGCCCTGACCAGC

GGCGTGCACACCTTCCCGGCTGTCCTACAGTCCTCAGGACTCTACTCCCTCAGCAGCGTGGT

GACCGTGCCCTCCAGCAGCTTGGGCACCCAGACCTACATCTGCAACGTGAATCACAAGCCCA

GCAACACCAAGGTGGACAAGAAAGTTGAGCCCAAATCTTGTGACAAAACTCACACATGCCC

ACCGTGCCCAGCACCTGAACTCCTGGGGGGACCGTCAGTCTTCCTCTTCCCCCCAAAACCCA

AGGACACCCTCATGATCTCCCGGACCCCTGAGGTCACATGCGTGGTGGTGGACGTGAGCCAC

GAAGACCCTGAGGTCAAGTTCAACTGGTACGTGGACGGCGTGGAGGTGCATAATGCCAAGA

CAAAGCCGCGGGAGGAGCAGTACAACAGCACGTACCGTGTGGTCAGCGTCCTCACCGTCCT

GCACCAGGACTGGCTGAATGGCAAGGAGTACAAGTGCAAGGTCTCCAACAAAGCCCTCCCA

GCCCCCATCGAGAAAACCATCTCCAAAGCCAAAGGGCAGCCCCGAGAACCACAGGTGTACA

CCCTGCCCCCATCCCGGGAGGAGATGACCAAGAACCAGGTCAGCCTGACCTGCCTGGTCAA

AGGCTTCTATCCCAGCGACATCGCCGTGGAGTGGGAGAGCAATGGGCAGCCGGAGAACAAC

TACAAGACCACGCCTCCCGTGCTGGACTCCGACGGCTCCTTCTTCCTCTACAGCAAGCTCAC

CGTGGACAAGAGCAGATGGCAGCAGGGGAACGTCTTCTCATGCTCCGTGATGCATGAGGCT

CTGCACAACCACTACACGCAGAAGAGCCTCTCCCTGTCTCCGGGTAAA

-continued (KL2B30 HC cDNA)

SEQ ID NO: 292

CAGGTGCAGCTGCAGGAGTCGGGCCCAGGACTGGTGAAGCCTTCGGAGACCCTGTCCCTCA
CCTGCACTGTCTCTGGTGGCTCCATCAGTAGTTACTACTGGAGCTGGATCCGGCAGCCCCCA
GGGAAGGGACTGGAGTGGATTGGATATATCTATTACAGTGGGAGCACCAACTACAACCCCT
CCCTCAAGAGTCGAGTCACCATATCAGTAGACACGTCCAAGAACCAGTTCTCCCTGAAGCTG
AGCTCTGTGACCGCTGCGGACACGGCCGTGTATTACTGTGCGGGGACTACGATTTTTGGAGT
GGTTACCCCCAACTTVTACTACGGTATGGACGTCTGGGGCCAAGGGACCACGGTCACCGTCT
CCTCAGCTTCCACCAAGGGCCCATCCGTCTTCCCCCTGGCGCCCTGCTCCAGGAGCACCTCC
GAGAGCACAGCCGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGCACGAAAACCTAC
ACTTGCAACGTAGATCACAAGCCCAGCAACACCAAGGTGGACAAGAGAGTTGAGTCCAAAT
ATGGTCCCCCATGCCCACCATGCCCAGCACCTGAGGCCGCCGGGGGACCATCAGTCTTCCTG
TTCCCCCCAAAACCCAAGGACACTCTCATGATCTCCCGGACCCCTGAGGTCACGTGCGTGGT
GGTGGACGTGAGCCAGGAAGACCCCGAGGTCCAGTTCAACTGGTACGTGGATGGCGTGGAG
GTGCATAATGCCAAGACAAAGCCGCGGGAGGAGCAGTTCAACAGCACGTACCGTGTGGTCA
GCGTCCTCACCGTCCTGCACCAGGACTGGCTGAACGGCAAGGAGTACAAGTGCAAGGTCTC
CAACAAAGGCCTCCCGTCCTCCATCGAGAAAACCATCTCCAAAGCCAAAGGGCAGCCCCGA
GAGCCACAGGTGTACACCCTGCCCCCATCCCAGGAGGAGATGACCAAGAACCAGGTCAGCC
TGACCTGCCTGGTCAAAGGCTTCTACCCCAGCGACATCGCCGTGGAGTGGGAGAGCAATGG
GCAGCCGGAGAACAACTACAAGACCACGCCTCCCGTGCTGGACTCCGACGGCTCCTTCTTCC
TCTACAGCAGGCTAACCGTGGACAAGAGCAGATGGCAGGAGGGGAATGTCTTCTCATGCTC
CGTGATGCATGAGGCTCTGCACAACCACTACACACAGAAGAGCCTCTCCCTGTCTCTGGGTA
AA (KL2B53 HC cDNA)

SEQ ID NO: 293

GAGGTGCAGCTGGTGGAGTCTGGGGGAGGCGTGGTCCAGCCTGGGAGGTCCCTGAGACTCT
CCTGTGTAGCCTCTGGATTCACCTTCAGTAGTTATGACATACACTGGGTCCGCCAGGCTCCA
GGCAAGGGGCTGGAGTGGGTGGCAATTATTTCATATGATGGAAGTAAAAAAGACTATACAG
ACTCCGTGAAGGGCCGATTCACCATCTCCAGAGACAATTCCAAGAACACGCTGTATCTGCAA
ATGGACAGCCTGAGAGTTGAGGACTCGGCTGTGTATTCCTGTGCGAGAGAAAGTGGCTGGTC
CCACTACTACTATTACGGTATGGACGTCTGGGGCCAAGGGACAATGGTCACCGTCTCTTCAG
CTTCCACCAAGGGCCCATCCGTCTTCCCCCTGGCGCCCTGCTCCAGGAGCACCTCCGAGAGC
ACAGCCGCCCTGGGCTGCCTGGTCAAGGACTACTTCCCCGAACCGGTGACGGTGTCGTGGAA
CTCAGGCGCCCTGACCAGCGGCGTGCACACCTTCCCGGCTGTCCTACAGTCCTCAGGACTCT
ACTCCCTCAGCAGCGTGGTGACCGTGCCCTCCAGCAGCTTGGGCACGAAAACCTACACTTGC
AACGTAGATCACAAGCCCAGCAACACCAAGGTGGACAAGAGAGTTGAGTCCAAATATGGTC
CCCCATGCCCACCATGCCCAGCACCTGAGGCCGCGGGGGACCATCAGTCTTCCTGTTCCCC
CCAAAACCCAAGGACACTCTCATGATCTCCCGGACCCCTGAGGTCACGTGCGTGGTGGTGGA
CGTGAGCCAGGAAGACCCCGAGGTCCAGTTCAACTGGTACGTGGATGGCGTGGAGGTGCAT
AATGCCAAGACAAAGCCGCGGGAGGAGCAGTTCAACAGCACGTACCGTGTGGTCAGCGTCC
TCACCGTCCTGCACCAGGACTGGCTGAACGGCAAGGAGTACAAGTGCAAGGTCTCCAACAA

AGGCCTCCCGTCCTCCATCGAGAAAACCATCTCCAAAGCCAAAGGGCAGCCCCGAGAGCCA

CAGGTGTACACCCTGCCCCCATCCCAGGAGGAGATGACCAAGAACCAGGTCAGCCTGACCT

GCCTGGTCAAAGGCTTCTACCCCAGCGACATCGCCGTGGAGTGGGAGAGCAATGGGCAGCC

GGAGAACAACTACAAGACCACGCCTCCCGTGCTGGACTCCGACGGCTCCTTCTTCCTCTACA

GCAGGCTAACCGTGGACAAGAGCAGATGGCAGGAGGGGAATGTCTTCTCATGCTCCGTGAT

GCATGAGGCTCTGCACAACCACTACACACAGAAGAGCCTCTCCCTGTCTCTGGGTAAA (KL2B242 HC cDNA)

SEQ ID NO: 294

CAGGTGCAGCTGCAGGAGTCGGGCCCAGGACTGGTGAAGCCTTCGGAGACCCTGTCCCTCA

CCTGCACTGTCTCTGGTGGCTCCATCAGTAGTTACTATTGGAGCTGGCTCCGGCAGCCCGCC

GGGTCGGGACTGGAGTGGATTGGGCGTTTATATGTCAGTGGGTTCACCAACTACAACCCCTC

CCTCAAGAGTCGAGTCACCTTGTCACTAGACCCGTCCAGGAACCAGTTGTCCCTGAAACTGA

GTTCTGTGACCGCCGCGGACACGGCCGTATATTATTGTGCGGGAGATAGTGGGAACTACTGG

GGTTGGTTCGACCCCTGGGGCCAGGGAACCCTGGTCACCGTCTCCTCAGCTTCCACCAAGGG

CCCATCCGTCTTCCCCCTGGCGCCCTGCTCCAGGAGCACCTCCGAGAGCACAGCCGCCCTGG

GCTGCCTGGTCAAGGACTACTTCCCCGAACCGGTGACGGTGTCGTGGAACTCAGGCGCCCTG

ACCAGCGGCGTGCACACCTTCCCGGCTGTCCTACAGTCCTCAGGACTCTACTCCCTCAGCAG

CGTGGTGACCGTGCCCTCCAGCAGCTTGGGCACGAAAACCTACACTTGCAACGTAGATCACA

AGCCCAGCAACACCAAGGTGGACAAGAGAGTTGAGTCCAAATATGGTCCCCCATGCCCACC

ATGCCCAGCACCTGAGGCCGCCGGGGGACCATCAGTCTTCCTGTTCCCCCCAAAACCCAAGG

ACACTCTCATGATCTCCCGGACCCCTGAGGTCACGTGCGTGGTGGTGGACGTGAGCCAGGAA

GACCCCGAGGTCCAGTTCAACTGGTACGTGGATGGCGTGGAGGTGCATAATGCCAAGACAA

AGCCGCGGGAGGAGCAGTTCAACAGCACGTACCGTGTGGTCAGCGTCCTCACCGTCCTGCAC

CAGGACTGGCTGAACGGCAAGGAGTACAAGTGCAAGGTCTCCAACAAAGGCCTCCCGTCCT

CCATCGAGAAAACCATCTCCAAAGCCAAAGGGCAGCCCCGAGAGCCACAGGTGTACACCCT

GCCCCCATCCCAGGAGGAGATGACCAAGAACCAGGTCAGCCTGACCTGCCTGGTCAAAGGC

TTCTACCCCAGCGACATCGCCGTGGAGTGGGAGAGCAATGGGCAGCCGGAGAACAACTACA

AGACCACGCCTCCCGTGCTGGACTCCGACGGCTCCTTCTTCCTCTACAGCAGGCTAACCGTG

GACAAGAGCAGATGGCAGGAGGGGAATGTCTTCTCATGCTCCGTGATGCATGAGGCTCTGC

ACAACCACTACACACAGAAGAGCCTCTCCCTGTCTCTGGGTAAA (KL2B467 HC cDNA)

SEQ ID NO: 295

CAGGTGCAGCTGGTGGAGTCTGGGGGAGGCGTGGTCCAGCCTGGGAGGTCCCTGAGACTCT

CCTGTGCAGCCTCTGGATTCACCTTCAGTTACTATGGCATGCACTGGGTCCGCCAGGCTCCA

GGCAAGGGGCTGGAGTGGGTGGCATTTATATCATATGATGGAAGTAATAAATACTATGCAG

ACTCCGTGAAGGGCCGATTCACCATCTCCAGAGACAATTCCAAGAACACGCTGTATCTGCAA

ATGAACAGCCTGAGAGCTGAGGACACGGCTGTGTATTACTGTGCCCACCTCCTTATAGTGG

GAGCTACTGGGCCTTTGACTACTGGGGCCAGGGAACCCAGGTCACCGTCTCTTCAGCCTCCA

CCAAGGGCCCATCGGTCTTCCCCCTGGCACCCTCCTCCAAGAGCACCTCTGGGGGCACAGCG

GCCCTGGGCTGCCTGGTCAAGGACTACTTCCCCGAACCGGTGACGGTGTCGTGGAACTCAGG

CGCCCTGACCAGCGGCGTGCACACCTTCCCGGCTGTCCTACAGTCCTCAGGACTCTACTCCCT

CAGCAGCGTGGTGACCGTGCCCTCCAGCAGCTTGGGCACCCAGACCTACATCTGCAACGTGA

-continued

ATCACAAGCCCAGCAACACCAAGGTGGACAAGAAAGTTGAGCCCAAATCTTGTGACAAAAC
TCACACATGCCCACCGTGCCCAGCACCTGAAGCCGCCGGGGGACCGTCAGTCTTCCTCTTCC
CCCCAAAACCCAAGGACACCCTCATGATCTCCCGGACCCCTGAGGTCACATGCGTGGTGGTG
AGCGTGAGCCACGAAGACCCTGAGGTCAAGTTCAACTGGTACGTGGACGGCGTGGAGGTGC
ATAATGCCAAGACAAAGCCGCGGGAGGAGCAGTACAACAGCACGTACCGTGTGGTCAGCGT
CCTCACCGTCCTGCACCAGGACTGGCTGAATGGCAAGGAGTACAAGTGCAAGGTCTCCAAC
AAAGCCCTCCCAGCCCCCATCGAGAAAACCATCTCCAAAGCCAAAGGGCAGCCCCGAGAAC
CACAGGTGTACACCCTGCCCCcATcCCGGGAGGAGATGACCAAGAACCAGGTCAGCCTGAC
CTGCCTGGTCAAAGGCTTCTATCCCAGCGACATCGCCGTGGAGTGGGAGAGCAATGGGCAG
CCGGAGAACAACTACAAGACCACGCCTCCCGTGCTGGACTCCGACGGCTCCTTCTTCCTCTA
CAGCAAGCTCACCGTGGACAAGAGCAGATGGCAGCAGGGGAACGTCTTCTCATGCTCCGTG
ATGCATGAGGCTCTGCACAACCACTACACGCAGAAGAGCCTCTCCCTGTCTCCGGGTAAA (KL2B494 HC cDNA)
SEQ ID NO: 274
CAGGTGCAGCTGGTGGAGTCTGGGGGAGGCTTGGTACAGCCTGGGGGGTCCCTGAGACTCT
CCTGTGCAGCCTCTGGATTCACCTTTAGTCATTATGCCATGAGCTGGGTCCGCCAGGCTCCAG
GGAAGGGGCTGGAGTGGGTCTCAACTATTGGTGGTAGTGGTGGTAGCACATACTACGCAGA
CTCCGTGAAGGGCCGGTTCACCATCTCCAGAGACAATTCCAAGAACACGCTGTATCTGCAAA
TGAACAGCCTGAGAGCCGAGGACACGGCCGTATATTACTGTGCGAAACCTCATATTGTAATG
GTGACTGCTCTTCTCTACGACGGTATGGACGTCTGGGGCCAAGGGACAATGGTCACCGTCTC
CTCAGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTAC
ATCTGCAACGTGAATCACAAGCCCAGCAACACCAAGGTGGACAAGAAAGTTGAGCCCAAAT
CTTGTGACAAAACTCACACATGCCCACCGTGCCCAGCACCTGAAGCCGCCGGGGGACCGTC
AGTCTTCCTCTTCCCCCCAAAACCCAAGGACACCCTCATGATCTCCCGGACCCCTGAGGTCA
CATGCGTGGTGGTGAGCGTGAGCCACGAAGACCCTGAGGTCAAGTTCAACTGGTACGTGGA
CGGCGTGGAGGTGCATAATGCCAAGACAAAGCCGCGGGAGGAGCAGTACAACAGCACGTA
CCGTGTGGTCAGCGTCCTCACCGTCCTGCACCAGGACTGGCTGAATGGCAAGGAGTACAAGT
GCAAGGTCTCCAACAAAGCCCTCCCAGCCCCCATCGAGAAAACCATCTCCAAAGCCAAAGG
GCAGCCCCGAGAACCACAGGTGTACACCCTGCCCCCATCCCGGGAGGAGATGACCAAGAAC
CAGGTCAGCCTGACCTGCCTGGTCAAAGGCTTCTATCCCAGCGACATCGCCGTGGAGTGGGA
GAGCAATGGGCAGCCGGAGAACAACTACAAGACCACGCCTCCCGTGCTGGACTCCGACGGC
TCCTTCTTCCTCTACAGCAAGCTCACCGTGGACAAGAGCAGATGGCAGCAGGGGAACGTCTT
CTCATGCTCCGTGATGCATGAGGCTCTGCACAACCACTACACGCAGAAGAGCCTCTCCCTGT
CTCCGGGTAAA (mu11B6 LC cDNA)
SEQ ID NO: 296
GACATTGTGCTGACACAGAGTCCAGCATCCTTGGCAGTATCTTTGGGGCAGCGGGCAACAAT
TTCATGCCGTGCATCTGAAAGTGTGGAGTATTTTGGAACTTCTCTTATGCACTGGTATCGCCA
GAAGCCTGGGCAGCCTCCCAAACTCCTTATATATGCCGCTTCCAACGTGGAGTCCGGAGTAC
CAGCACGCTTTTCCGGCTCTGGGTCCGGCACAGACTTTTCCCTCAATATCCAACCTGTTGAAG

-continued

```
AAGACGATTTTTCCATGTATTTTTGCCAACAGACACGCAAGGTTCCATATACATTCGGCGGC

GGCACTAAACTTGAGATCAAACGGGCTGATGCTGCACCGACTGTGTCCATCTTCCCACCATC

CAGTGAGCAGTTAACATCTGGAGGTGCCTCAGTCGTGTGCTTCTTGAACAACTTCTACCCCA

AAGACATCAATGTCAAGTGGAAGATTGATGGCAGTGAACGACAAAATGGCGTCCTGAACAG

TTGGACTGATCAGGACAGCAAAGACAGCACCTACAGCATGAGCAGCACCCTCACGTTGACC

AAGGACGAGTATGAACGACATAACAGCTATACCTGTGAGGCCACTCACAAGACATCAACTT

CACCCATTGTCAAGAGCTTCAACAGGAATGAGTGT
```

(hu11B6 LC cDNA)

SEQ ID NO: 297
```
GACATAGTCTTGACTCAGAGCCCGGATTCCCTTGCTGTGTCTCTGGGAGAACGAGCTACGAT

CAACTGCAAGGCAAGTGAATCCGTAGAATACTTCGGGACATCATTGATGCATTGGTATCAAC

AGAAACCGGGGCAACCGCCCAAATTGCTGATATATGCGGCTAGTAKTAGAGAATCAGGAGT

ACCGGATAGGTTTAGTGGTTCAGGATCAGGTACAGATTTCACCCTGACAATAAGTAGCTTGC

AAGCCGAAGACGTAGCAGTGTATTACTGCCAACAAACCCGAAAGGTGCCATATACGTTTGG

ACAGGGTACAAAGTTGGAAATCAAACGTACGGTGGCTGCACCATCTGTCTTCATCTTCCCGC

CATCTGATGAGCAGTTGAAATCTGGAACTGCCTCTGTTGTGTGCCTGCTGAATAACTTCTATC

CCAGAGAGGCCAAAGTACAGTGGAAGGTGGATAACGCCCTCCAATCGGGTAACTCCCAGGA

GAGTGTCACAGAGCAGGACAGCAAGGACAGCACCTACAGCCTCAGCAGCACCCTGACGCTG

AGCAAAGCAGACTACGAGAAACACAAAGTCTACGCCTGCGAAGTCACCCATCAGGGCCTGA

GCTCGCCCGTCACAAAGAGCTTCAACAGGGGAGAGTGT
```

(KL2B30 LC cDNA)

SEQ ID NO: 450
```
GACATCCAGATGACCCAGTCTCCTTCCTTCCTGTCTGCATCTGTAGGAGACAGAGTCACCAT

CACTTGCCGGGCCAGTCAGGGCATTAGCAGTTATTTAGCCTGGTATCAGCAAAAACCAGGGA

AAGCCCCTAAGTTCCTGATCTATGCTGCATCCACTTMCAAAGTGGGGTCCCATCAAGGTTC

AGCGGCAGTGGATCTGGGACAGAATTCACTCTCACAATCAGCAGCCTGCAGCCTGAAGATTT

TGCAACTTATTACTGTCAACAGCTTAATAGTTACCCTCTCACTTTCGGCGGAGGGACCAAGG

TGGAAATCAAACGTACGGTGGCTGCACCATCTGTCTTCATCTTCCCGCCATCTGATGAGCAG

TTGAAATCTGGAACTGCCTCTGTTGTGTGCCTGCTGAATAACTTCTXFCCCCAGAGAGGCCAA

AGTACAGTGGAAGGTGGATAACGCCCTCCAATCGGGTAACTCCCAGGAGAGTGTCACAGAG

CAGGACAGCAAGGACAGCACCTACAGCCTCAGCAGCACCCTGACGCTGAGCAAAGCAGACT

ACGAGAAACACAAAGTCTACGCCTGCGAAGTCACCCATCAGGGCCTGAGCTCGCCCGTCAC

AAAGAGCTTCAACAGGGGAGAGTGT
```

(KL2B53 LC cDNA)

SEQ ID NO: 451
```
GACATCGTGATGACCCAGTCTCCATCCTCCCTGTCTGCATCTGTAGGAGACAGAGTCACCAT

CACTTGCCGGGCGAGTCAGGACATTAGCAATTATTTAGCCTGGTATCAGCAGAAACCAGGG

AAAGTTCCTAAGTTCCTGATCTATGCTGCATCCACTTTGCACTCTGGGGTCCCATCTCGGTTC

AGTGGCAGTGGATCTGGGACAGATTTCACTCTCACCATCAGCAGCCTGCAGCCTGAAGATGT

TGCAACTTATTACTGTCAAAAGTATAACAGTGCCCCGTACACTTTTGGCCAAGGGACACGAC

TGGAGATTAAACGTACGGTGGCTGCACCATCTGTCTTCATCTTCCCGCCATCTGATGAGCAG

TTGAAATCTGGAACTGCCTCTGTTGTGTGcCTGCTGAATAACTTCTATCCCAGAGAGGCCAA

AGTACAGTGGAAGGTGGATAACGCCCTCCAATCGGGTAACTCCCAGGAGAGTGTCACAGAG
```

-continued

CAGGACAGCAAGGACAGCACCTACAGCCTCAGCAGCACCCTGACGCTGAGCAAAGCAGACT

ACGAGAAACACAAAGTCTACGCCTGCGAAGTCACCCATCAGGGCCTGAGCTCGCCCGTCAC

AAAGAGCTTCAACAGGGGAGAGTGT (KL2B242 LC cDNA)
SEQ ID NO: 305
TCCTATGAGCTGACTCAGCCACCCTCAGTGTCCGTGTCCCCAGGAGAGACAGCCAGCATCAC

CTGCTCTGGAGATCAATTGGGGGAAAATTATGCTTGCTGGTATCAGCAGAAGCCAGGCCAGT

CCCCTGTGTTGGTCATCTATCAAGATAGTAAGCGGCCCTCAGGGATCCCTGAGCGATTCTCT

GGCTCCAACTCTGGGAACACAGCCACTCTGACCATCAGCGGGACCCAGGCTCTGGATGAGG

CTGACTATTACTGTCAGGCGTGGGACAACAGTATTGTGGTATTCGGCGGAGGGACCAAGCTG

ACCGTCCTAGGTCAGCCCAAGGCTGCACCCAGTGTCACTCTGTTCCCGCCCTCCTCTGAGGA

GCTTCAAGCCAACAAGGCCACACTGGTGTGTCTCATAAGTGACTTCTACCCGGGAGCCGTGA

CAGTGGCCTGGAAGGCCGATAGCAGCCCCGTCAAGGCGGGAGTGGAGACCACCACACCCTC

CAAACAAAGCAACAACAAGTACGCGGCCAGCAGCTATCTGAGCCTGACGCCTGAGCAGTGG

AAGTCCCACAGAAGCTACAGCTGCCAGGTCACGCATGAAGGGAGCACCGTGGAGAAGACAG

TGGCCCCTACAGAATGTTCA (KL2B467 LC cDNA)
SEQ ID NO: 306
CAGTCTGTGCTGACTCAGCCACCCTCGGTGTCAGTGGCCCCCGGGCAGACGGCCAGTATTAC

CTGTGGGGAGACAACATTGGAAGTAAAAGTGTGCACTGGTACCAGCAGAAGCCAGGCCAG

GCCCCTGTGCTGGTCGTCTATGATAATAGCGACCGGCCCTCAGGGATCCCTGAGCGATTCTC

TGGCTCCAACTCTGGGACCACGGCCACCCTGACCATCAGCAGGGTCGAAGCCGGGGATGAG

GCCGACTATTACTGTCAGGTGTGGGATAGTAGTAGTGATCATCCTGTGGTATTCGGCGGAGG

GACCAAGGTCACCGTCCTAGGTCAGCCCAAGGCTGCACCCAGTGTCACTCTGTTCCCGCCCT

CCTCTGAGGAGCTTCAAGCCAACAAGGCCACACTGGTGTGTCTCATAAGTGACTTCTACCCG

GGAGCCGTGACAGTGGCCTGGAAGGCCGATAGCAGCCCCGTCAAGGCGGGAGTGGAGACCA

CCACACCCTCCAAACAAAGCAACAACAAGTACGCGGCCAGCAGCTATCTGAGCCTGACGCC

TGAGCAGTGGAAGTCCCACAGAAGCTACAGCTGCCAGGTCACGCATGAAGGGAGCACCGTG

GAGAAGACAGTGGCCCCTACAGAATGTTCA (KL2B494 LC cDNA)
SEQ ID NO: 282
TCTTCTGAGCTGACTCAGCCACCCTCGGTGTCAGTGGCCCCAGGACAGACGGCCAGGATTAC

CTGTGGGGGAAACAACATTGGAAGTAAAAGTGTGCACTGGTACCAGCAGAAGCCAGGCCAG

GCCCCTGTGCTGGTCGTCTATGATGATAGCGACCGGCCCTCAGGGATCCCTGAGCGATTCTC

TGGCTCCAACTCTGGGAACACGGCCACCCTGACCATCAGCAGGGTCGAAGCCGGGGATGAG

GCCGACTATTACTGTCAGGTGTGGGATAGTAGTAGTGATCATGTGGTATTCGGCGGAGGGAC

CAAGCTGACCGTCCTAGGTCAGCCCAAGGCTGCACCCAGTGTCACTCTGTTCCCGCCCTCCT

CTGAGGAGCTTCAAGCCAACAAGGCCACACTGGTGTGTCTCATAAGTGACTTCTACCCGGGA

GCCGTGACAGTGGCCTGGAAGGCCGATAGCAGCCCCGTCAAGGCGGGAGTGGAGACCACCA

CACCCTCCAAACAAAGCAACAACAAGTACGCGGCCAGCAGCTATCTGAGCCTGACGCCTGA

GCAGTGGAAGTCCCACAGAAGCTACAGCTGCCAGGTCACGCATGAAGGGAGCACCGTGGAG

AAGACAGTGGCCCCTACAGAATGTTCA

TABLE 13

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| scFv1 | HCG5_LDC6_HL | QVQLQESGPGLVKPSDTLSLTCAVSGNSITSDYAWN WIRQFPGKGLEWMGYISYSGSTTYNPSLKSRVTISRD TSKNQFSLKISSVTPVDTAVYYCATGYYYGSGFWG QGTLVTVSSGGSEGKSSGSGSESKSTGGSDIVLTQSP DSLAVSLGERATINCKASESVEYFGTSLMHWYQQKP GQPPKLLIYAASNRESGVPDRFSGSGSGTDFTLTIQSV QAEDVSVYFCQQTRKVPYTFGQGTKLEIK | 8 |
| scFv2 | HCG5_hu11B6_HL | QVQLQESGPGLVKPSDTLSLTCAVSGNSITSDYAWN WIRQFPGKGLEWMGYISYSGSTTYNPSLKSRVTISRD TSKNQFSLKLSSVTPVDTAVYYCATGYYYGSGFWG QGTLVTVSSGGSEGKSSGSGSESKSTGGSDIVLTQSP DSLAVSLGERATINCKASESVEYFGTSLMHWYQQKP GQPPKLLIYAASNRESGVPDRFSGSGSGTDFTLTISSL QAEDVAVYYCQQTRKVPYTFGQGTKLEIK | 9 |
| scFv3 | HCF3_hu11B6_HL | QVQLQESGPGLVKPSDTLSLTCAVSGNSITSDYAWN WIRQFPGKGLEWIGYISYSGSTTYNPSLKSRVTISRDT SKNQFSLKLSSVTPVDTAVYYCATGYYYGSGFWGQ GTLVTVSSGGSEGKSSGSGSESKSTGGSDIVLTQSPD SLAVSLGERATINCKASESVEYFGTSLMHWYQQKPG QPPKLIYAASNRESGVPDRFSGSGSGMFTLTISSVQ AEDVAVYYCQQTRKVPYTFGQGTKLEIK | 10 |
| scFv4 | HCG5_LCB7_HL | QVQLQESGPGLVKPSDTLSLTCAVSGNSITSDYAWN WIRQFPGKGLEWMGYISYSGSTTYNPSLKSRVTISRD TSKNQFSLKLSSVTPVDTAVYYCATGYYYGSGFWG QGTLVTVSSGGSEGKSSGSGSESKSTGGSDIVLTQSP DSLAVSLGERATINCKASESVEYFGTSLMHWYQQKP GQPPKLLIYAASNRESGVPDRFSGSGSGMFTLTISSV QAEDVAVYYCQQTRKVPYTFGQGTKLEIK | 11 |
| scFv5 | LCD6_HCG5_LH | DIVLTQSPDSLAVSLGERATINCKASESVEYFGTSLM HWYQQKPGQPPKLLIYAASNRESGVPDRFSGSGSGT DFTLTIQSVQAEDVSVYFCQQTRKVPYTFGQGTKLEI KGGSEGKSSGSGSESKSTGGSQVQLQESGPGLVKPS DTLSLTCAVSGNSITSDYAWNWIRQFPGKGLEWMG YISYSGSTTYNPSLKSRVTISRDTSKNQFSLKLSSVTP VDTAVYYCATGWYGSGFWGQGTLVTVSS | 12 |
| scFv6 | hut11B6_HCF3_LH | DIVLTQSPDSLAVSLGERATINCKASESVEYFGTSLM HWYQQKPGQPPKLLIYAASNRESGVPDRFSGSGSGT DFTLTISSLQAEDVAVYYCQQTRKVPYTFGQGTKLEI KGGSEGKSSGSGSESKSTGGSQVQLQESGPGLVKPS DTLSLTCAVSGNSITSDYAWNWIRQFPGKGLEWIGYI SYSGSTTYNPSLKSRVTISRDTSKNQFSLKLSSVTPVD TAVYYCATGYYYGSGFWGQGTLVTVSS | 13 |
| scFv7 | hu11B6_HCG5_LH | DIVLTQSPDSLAVSLGERATINCKASESVEYFGTSLM HWYQQKPGQPPKLLIYAASNRESGVPDRFSGSGSGT DFTLTISSLQAEDVAVYYCQQTRKVPYTFGQGTKLEI KGGSEGKSSGSGSESKSTGGSQVQLQESGPGLVKPS DTLSLTCAVSGNSITSDYAWNWIRQFPGKGLEWMG YISYSGSTTYNPSLKSRVTISRDTSKNQFSLKLSSVTP VDTAVYYCATGYYYGSGFWGQGTLVTVSS | 14 |
| scFv8 | LCB7_HCF3_LH | DIVLTQSPDSLAVSLGERATINCKASESVEYFGTSLM HWYQQKPGQPPKLLIYAASNRESGVPDRFSGSGSGT DFTLTISSVQAEDVAVYYCQQTRKVPYTFGQGTKLE IKGGSEGKSSGSGSESKSTGGSQVQLQESGPGLVKPS DTLSLTCAVSGNSITSDYAWNWIRQFPGKGLEWIGYI SYSGSTTYNPSLKSTSTISRDISKNQFSLKLSSVTPVD TAVYYCATGYYYGSGFWGQGTLVTVSS | 15 |
| scFv9 | LCB7_HCG5_LH | DIVLTQSPDSLAVSLGERATINCKASESVEYFGTSLM HWYQQKPGQPPKLLIYAASNRESGVPDRFSGSGSGT DFTLTISSVQAEDVAVYYCQQTRKVPYTFGQGTKLE IKGGSEGKSSGSGSESKSTGGSQVQLQESGPGLVKPS DTLSLTCAVSGNSITSDYAWNWIRQFPGKGLEWMG YISYSGSTTYNRSLKSRVTISRDTSKNQFSLKLSSVTP VDTAVYYCATGYYYGSGFWGQGTLVTVSS | 16 |
| scFv10 | LCD6_HCF3_LH | DIVLTQSPDSLAVSLGERATINCKASESVEYFGTSLM HWYQQKPGQPPKLLIYAASNRESGVPDRFSGSGSGT | 17 |

TABLE 13-continued

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| | | DFTLTIQSVQAEDVSVYFCQQTRKVPYTFGQGTKLEI<br>KGGSEGKSSGSGSESKSTGGSQVQLQESGPGLVKPS<br>DTLSLTCAVSGNSITSDYAWNWIRQFPGKGLEWIGYI<br>SYSGSTTYNPSLKSRVTISRDTSKNQFSLKLSSVTPVD<br>TAVYYCATGYYYGSGFWGQGTLVTVSS | |
| scFv11 | hu11B6_LCB7_HL | QVQLQESGPGLVKPSDTLSLTCAVSGNSITSDYAWN<br>WIRQPPGKGLEWIGYISYSGSTTYNPSLKSRVTMSRD<br>TSKNQFSLKLSSVTAVDTAVYYCATGYYYGSGFWG<br>QGTLVTVSSGGSEGKSSGSGSESKSTGGSDIVLTQSP<br>DSLAVSLGERATINCKASESVEYFGTSLMHWYQQKP<br>GQPPKLLIYAASNRESGVPDRFSGSGSGTDFTLTISSV<br>QAEDVAVYYCQQTRKVPYTFGQGTKLEIK | 18 |
| scFv12 | hu11B6_LCD6_HL | QVQLQESGPGLVKPSDTLSLTCAVSGNSITSDYAWN<br>WIRQPPGKGLEWIGYISYSGSTTYNPSLKSRVTMSRD<br>TSKNQFSLKLSSVTAVDTAVYYCATGYYYGSGFWG<br>QGTLVTVSSGGSEGKSSGSGSESKSTGGSDIVLTQSP<br>DSLAVSLGERATINCKASESVEYFGTSLMHWYQQKP<br>GQPPKLLIYAASNRESGVPDRFSGSGSGTDFTLTIQSV<br>QAEDVSVYHCQQTRKVPYTFGQGTKLEIK | 19 |
| scFv13 | hu11B6_HL | QVQLQESGPGLVKPSDTLSLTCAVSGNSITSDYAWN<br>WIRQPPGKGLEWIGYISYSGSTTYNPSLKSRVTMSRD<br>TSKNQFSLKLSSVTAVDTAVYYCATGYYYGSGFWG<br>QGTLVTVSSGGSEGKSSGSGSESKSTGGSDIVLTQSP<br>DSLAVSLGERATINCKASESVEYFGTSLMHWYQQKP<br>GQPPKLLIYAASNRESGVPDRFSGSGSGTDFTLTISSL<br>QAEDVAVYYCQQTRKVPYTFGQGTKLEIK | 20 |
| scFv14 | hu11B6_LH | DIVLTQSPDSLAVSLGERATINCKASESVEYFGTSLM<br>HWYQQKPGQPPKLLIYAASNRESGVPDRFSGSGSGT<br>DFTLTIQSVQAEDVSVYFCQQTRKVPYTFGQGTKLEI<br>KGGSEGKSSGSGSESKSTGGSQVQLQESGPGLVKPS<br>DTLSLTCAVSGNSITSDYAWNWIRQPPGKGLEWIGYI<br>SYSGSTTYNPSLKSRVTMSRDTSKNQFSLKLSSVTAV<br>DTAVYYCATGYYYGSGFWGQGTLVTVSS | 21 |
| scFv15 | hu11B6_LH | DIVLTQSPDSLAVSLGERATINCKASESVEYFGTSLM<br>HWYQQKPGQPPKLLIYAASNRESGVPDRFSGSGSGT<br>DFTLTISSLQAEDVAVYYCQQTRKVPYTFGQGTKLEI<br>KGGSEGKSSGSGSESKSTGGSQVQLQESGPGLVKPS<br>DTLSLTCAVSGNSITSDYAWNWIRQPPGKGLEWIGYI<br>SYSGSTTYNPSLKSRVTMSRDTSKNQFSLKLSSVTAV<br>DTAVYYCATGYYYGSGFWGQGTLVTVSS | 22 |
| scFv16 | LCB7_hu11B6_LH | DIVLTQSPDSLAVSLGERATINCKASESVEYFGTSLM<br>HWYQQKPGQPPKLLIYAASNRESGVPDRFSGSGSGT<br>DFILTISSVQAEDVAVYYCQQTRKVVYTFGQGTKLE<br>IKGGSEGKSSGSGSESKSTGGSQVQLQESGPGLVKPS<br>DTLSLTCAVSGNSITSDYAWNWIRQPPGKGLEWIGYI<br>SYSGSTTYNPSLKSRVTMSRDTSKNQFSLKLSSVTAV<br>DTAVYYCATGYYYGSGFWGQGTLVTVSS | 23 |
| scFv17 | KL2B413_HL | EVQLVESGGGLVQPGGSLRLSCAASGFTFSSYWMT<br>WVRQAPGKGLEWVANIKQDGSERYYVDSVKGRFTI<br>SRDNAKNSLYLQMNSLRAEDTAVYYCARDQNYDIL<br>TGHYGMDVWGQGTTVTVSSGGSEGKSSGSGSESKS<br>TGGSEIVLTQSPSFLSASVGDRVTITCRASQGISSYLS<br>WYQQKPGKAPKLLIYATSTLQSGVPSRFSGSGSGTEF<br>TLTISSLQPEDFATYYCQQLNSYPRTFGQGTKVEIK | 133 |
| scFv18 | KL2B413_LH | EIVLTQSPSFLSASVGDRVTITCRASQGISSYLSWYQQ<br>KPGKAPKLLIYATSTLQSGVPSRFSGSGSGTEFTLTIS<br>SLQPEDFATYYCQQLNSYPRTFGQGTKVEIKGGSEG<br>KSSGSGSESKSTGGSEVQLVESGGGLVQPGGSLRLSC<br>AASGFTFSSYWMTWVRQAPGKGLEWVANIKQDGSE<br>RYYVDSVKGRFTISRDNAKNSLYLQMNSLRAEDTA<br>VYYCARDQNYDILTGHYGMDVWGQGTTVTVSS | 134 |
| scFv19 | KL2B359_HL | QVQLQESGPGLVKPSQTLSLTCTVSGNSITSDYAWN<br>WIRQFPGKRLEWIGYISYSGSTTYNPSLKSRVTISRDT<br>SKNQFSLKLSSVTAADTAVYYCATGYYYGSGFWGQ<br>GTLVTVSSGGSEGKSSGSGSESKSTGGSEIVLTQSPAT | 135 |

TABLE 13-continued

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| | | LSLSPGERATLSCRASESVEYFGTSLMHWYQQKPGQ PPRLLIYAASNVESGIPARFSGSGSGTDFTLTISSVEPE DFAVYFCQQTRKVPYTFGGGTKVEIK | |
| scFv20 | KL2B359_LH | EIVLTQSPATLSLSPGERATLSCRASESVEYFGTSLMH WYQQKPGQPPRLLIYAASNVESGIPARFSGSGSGTDF TLTISSVEPEDFAVYFCQQTRKVPYTFGGGTKVEIKG GSEGKSSGSGSESKSTGGSQVQLQESGPGLVKPSQTL SLTCTVSGNSITSDYAWNWIRQFPGKRLEWIGYISYS GSTTYNPSLKSRVTISRDTSKNQFSLKLSSVTAADTA VYYCATGYYYGSGFWGQGTLVTVSS | 136 |
| scFv21 | KL2B357_HL | QVQLQESGPGLVKPSQTLSLTCTVSGNSITSDYAWN WIRQFPGKGLEWIGYISYSGSTTYNPSLKSRVTISRDT SKNQFSLKLSSVTAADTAVYYCATGYYYGSGFWGQ GTLVTVSSGGSEGKSSGSGSESKSTGGSDIVLTQSPD SLAVSLGERATINCRASESVEYFGTSLMHWYQQKPG QPPKLLIYAASNVESGVPDRFSGSGSGTDFTLTISSLQ AEDVAVYFCQQTRKVPYTFGGGTKVEIK | 318 |
| scFv22 | KL2B357_LH | DIVLTQSPDSLAVSLGERATINCRASESVEYFGTSLM HWYQQKPGQPPKLLIYAASNVESGVPDRFSGSGSGT DFTLTISSLQAEDVAVYFCQQTRKVPYTFGGGTKVEI KGGSEGKSSGSGSESKSTGGSQVQLQESGPGLVKPS QTLSLTCTVSGNSITSDYAWNWIRQFPGKGLEWIGYI SYSGSTTYNPSLKSRVTISRDTSKNQFSLKLSSVTAA DTAVYYCATGYYYGSGFWGQGTLVTVSS | 319 |
| scFv23 | KL2B358_HL | QVQLQESGPGLVKPSQTLSLTCTVSGNSITSDYAWN WIRQPPGKGLEWIGYISYSGSTTYNPSLKSRVTISRDT SKNQFSLKLSSVTAADTAVYYCATGYYYGSGFWGQ GTLVTVSSGGSEGKSSGSGSESKSTGGSEIVLTQSPAT LSLSPGERATLSCRASESVEYFGTSLMHWYQQKPGQ PPRLLIYAASNVESGIPARFSGSGSGTDFTLTISSVEPE DFAVNTCQQTRKVPYTFGGGTKVEIK | 320 |
| scFv24 | KL2B358_LH | EIVLTQSPATLSLSPGERATLSCRASESVEYFGTSLMH WYQQKPGQPPRLLIYAASNVESGIPARFSGSGSGTDF TLTISSVEPEDFAVYFCQQTRKVPYTFGGGTKVEIKG GSEGKSSGSGSESKSTGGSQVQLQESGPGLVKPSQTL SLTCTVSGNSITSDYAWNWIRQPPGKGLEWIGYISYS GSTTYNPSLKSRVTISRDISKNQFSLKLSSVTAADTA VYYCATGYYYGSGFWGQGTLVTVSS | 321 |
| scFv25 | KL2B360_HL | QVQLQESGPGLVKPSQTLSLTCTVSGNSITSDYAWN WIRQFPGKGLEWIGYISYSGSTTYNPSLKSRVTISRDT SKNQFSLKLSSVTAADTAVYYCATGYYYGSGFWGQ GTLVTVSSGGSEGKSSGSGSESKSTGGSEIVLTQSPAT LSLSPGERATLSCRASESVEYFGTSLMHWYQQKPGQ PPRLLIYAASNVESGIPARFSGSGSGTDFTLTISSVEPE DFAVYFCQQTRKVPYTFGGGTKVEIK | 322 |
| scFv26 | KL2B360_LH | EIVLTQSPATLSLSPGERATLSCRASESVEYFGTSLMH WYQQKPGQPPRLIYAASNVESGIPARFSGSGSGTDF TLTISSVEPEDFAVYFCQQTRKVPYTFGGGTKVEIKG GSEGKSSGSGSESKSTGGSQVQLQESGPGLVKPSQTL SLTCTVSGNSTISDYAWNWIRQFPGKGLEWIGYISYS GSTTYNPSLKSRVTISRDTSKNQFSLKLSSVTAADTA VYYCATGYYYGSGFWGQGTLVTVSS | 323 |
| scFv27 | KL2B467_HL | QVQLVESGGGVVQPGRSLRLSCAASGFTFSYYGMH WVRQAPGKGLEWVAFISYDGSNKYYADSVKGRFTI SRDNSKNTLYLQMNSLRAEDTAVYYCAHLPYSGSY WAFDYWGQGTQVTVSSGGSEGKSSGSGSESKSTGG SQSVLTQPPSVSVAPGQTASITCGGDNIGSKSVHWY QQKPGQAPVLVVYDNSDRPSGIPERFSGSNSGTTATL TISRVEAGDEADYYCQVWDSSSDHPVVFGGGTKVT V | 324 |
| scFv28 | KL2B467_LH | QSVLTQPPSVSVAPGQTASITCGGDNIGSKSVHWYQ QKPGQAPVLVVYDNSDRPSGIPERFSGSNSGTTATLT ISRVEAGDEADYYCQVWDSSSDHPVVFGGGTKVTV GGSEGKSSGSGSESKSTGGSQVQLVESGGGVVQPGR SLRLSCAASGFTFSYYGMFAVVRQAPGKGLEWVAFI | 325 |

TABLE 13-continued

Amino acid sequences of the variable domain of selected anti-hK2 scFvs antibodies in VH-linker-VL (HL) or in VL-linker-VH (LH) format.

| scFv name | Acronym | Amino acid sequence of scFv | SEQ ID NO: |
|---|---|---|---|
| | | SYDGSNKYYADSVKGRFTISRDNSKNTLYLQMNSLR AEDTAVYYCAHLPYSGSYWAFDYWGQGTQVTSS | |
| scFv39 | KL2B494_HL | QVQLVESGGGLVQPGGSLRLSCAASGFTSFSHYAMS WVRQAPGKGLEWVSTIGGSGGSTYYADSVKGRFTIS RDNSKNTLYLQMNSLRAEDTAVYYCAKPHIVMVTA LLYDGMDTVINGQGTMVTVSS GGSEGKSSGSGSESKSTGGSSSELTQPPSVSVAPGQT ARITCGGNNIGSKSVFIWYQQKPGQAPVLVVYDDSD RPSGIPERFSGSNSGNTATLTISRVEAGDEADYYCQV WDSSSDHVVFGGGTKLTVL | 308 |
| scFv40 | KL2B494_LH | SSELTQPPSVSVAPGQTARITCGGNNIGSKSHWYQ QKPGQAPVLVVYDDSDRPSGIPERFSGSNSGNTATLT ISRVEAGDEADYYCQVWDSSSDHVVFGGGTKLTVL GGSEGKSSGSGSESKSTGGSQVQLVESGGGLVQPGG SLRLSCAASGFTFSHYAMSWVRQAPGKGLEWVSTIG GSGGSTYYADSVKGRFTISRDNSKNTLYLQMNSLRA EDTAVYYCAKPHIVMVTALLYDGMDVWGQGTMVT VSS | 316 |
| scFv41 | KL2B30_HL | QVQLQESGPGLVKPSETLSLTCTVSGGSISSYYWSWI RQPPGKGLEWIGYIYYSGSTNYNPSLKSRVTISVDTS KNQFSLKLSSVTAADTAVYYCAGTTIFGVVTPNFYY GMDVWGQGTTVTVSSGGSEGKSSGSGSESKSTGGS DIQMTQSPSFLSASVGDRVTITCRASQGISSYLAWYQ QKPGKAPKFLIYAASTLQSGVPSRFSGSGSGTEFTLTI SSLQPEDFATYYCQQLNSYPLTFGGGTKVEIK | 404 |
| scFv42 | KL2B30_LH | DIQMTQSPSFLSASVGDRVTITCRASQGISSYLAWYQ QKPGKAPKFLIYAASTLQSGVPSRFSGSGSGTEFTLTI SSLQPEDFATYYCQQLNSYPLTFGGGTKVEIKGGSEG KSSGSGSESKSTGGSQVQLQESGPGLVKPSETLSLTC TVSGGSISSYYWSWIRQPPGKGLEWIGYIYYSGSTNY NPSLKSRVTISVDTSKNQFSLKLSSVTAADTAVYYCA GTTIFGVVTPNFYYGMDVWGQGTTVTVSS | 405 |
| scFv43 | KL2B53_HL | EVQLVESGGGVVQPGRSLRLSCVASGFTFSSYDIHW VRQAPGKGLEWVAIISYDGSKKDYTDSVKGRFTISR DNSKNTLYLQMDSLRVEDSAVYSCARESGWSHYYY YGMDVWGQGTMVTVSSGGSEGKSSGSGSESKSTGG SDIVMTQSPSSLSASVGDRVTITCRASQDISNYLAWY QQKPGKVPKFLIYAASTLHSGVPSRFSGSGSGTDFTL TISSLQPEDVATYYCQKYNSAPYTFGQGTRLEIK | 406 |
| scFv44 | KL2B53_LH | DIVMTQSPSSLSASVGDRVTITCRASQDISNYLAWYQ QKPGKVPKFLIYAASTLHSGVPSRFSGSGSGTDFTLTI SSLQPEDVATYYCQKYNSAPYTFGQGTRLEIKGGSE GKSSGSGSESKSTGGSEVQLVESGGGVVQPGRSLRL SCVASGFTFSSYDIHWVRQAPGKGLEWVAIISYDGS KKDYTDSVKGRFTISRDNSKNTLYLQMDSLRVEDSA VYSCARESGWSHYYYYGMDVWGQGTMVTVSS | 407 |
| scFv45 | KL2B242_HL | QVQLQESGPGLVKPSETLSLTCTVSGGSISSYYWSWL RQPAGSGLEWIGRLYVSGFTNYNPSLKSRVTLSLDPS RNQLSLKLSSVTAADTAVYYCAGDSGNYWGWFDP WGQGTLVTVSSGGSEGKSSGSGSESKSTGGSSYELT QPPSVSVSPGETASITCSGDQLGENYACWYQQKPGQ SPVLVIYQDSKRPSGIPERFSGSNSGNTATLTISGTQA LDEADYYCQAWDNSIVVFGGGTKLTVL | 408 |
| scFv46 | KL2B242_LH | SYELTQPPSVSVSPGETASITCSGDQLGENYACWYQ QKPGQSPVLVIYQDSKRPSGIPERFSGSNSGNTATLTI SGTQALDEADYYCQAWDNSIVVFGGGTKLTVLGGS EGKSSGSGSESKSTGGSQVQLQESGPGLVKPSETLSL TCTVSGGSISSYYWSWLRQPAGSGLEWIGRLYVSGF TNYNPSLKSRVTLSLDPSRNQLSLKLSSVTAADTAV YYCAGDSGNYWGWFDPWGQGTLVTVSS | 409 |

Example 3. Biophysical Characterization of Anti-hK2 Antibodies

Affinity and Thermal Stability of Anti-hK2 Antibodies.

Affinity of selected hK2 antibodies for soluble hK2 was measured by surface plasmon resonance (SPR). SPR is a label-free technique to study the strength of an interaction between two binding partners by measuring the change in mass upon complex formation and dissociation. Antibodies were captured on a sensor chip coated with an anti-Fc antibody followed by injection of soluble hK2 at various concentrations and specified association and dissociation times. Post dissociation, the surface was regenerated with an appropriate solution to prepare for the next interaction. Kinetic information (on-rate and off-rate constants) were extracted by fitting sensorgrams to the 1:1 Langmuir model. Binding affinity ($K_D$) are reported as the ratio of rate constants ($k_{off}/k_{on}$). $K_D$ values of selected hK2 antibodies are listed in Table 14.

Thermal stability was determined by Differential Scanning Fluorimetry (NanoDSF) using an automated Prometheus instrument. NanoDSF was used to measure $T_m$ of molecules at a concentration of 0.5 mg/mL in Phosphate Buffered Saline, pH 7.4. Measurements were made by loading samples into 24 well capillary from a 384 well sample plate. Duplicate runs were performed for each sample. The thermal scans span from 20° C. to 95° C. at a rate of 1.0° C./minute. Intrinsic tryptophan and tyrosine fluorescence were monitored at the emission wavelengths of 330 nm and 350 nm, and the F350/F330 nm ratio were plotted against temperature to generate unfolding curves. Measured Tm values are listed in Table 14.

TABLE 14

$K_D$ and Tm of selected molecules

| Molecule | $K_D$ (nM) | Tm (° C.) |
| --- | --- | --- |
| KL2B413 (scFv-LH-Fc) | 34.3 | 67 |
| KL2B359 (scFv-LH-Fc) | 0.7-1 | 67 |
| KL2B30 (Fab) | 0.460 | >70 |
| KL2B242 (Fab) | 0.040 | >70 |
| KL2B53 (Fab) | 0.080 | >70 |
| KL2B467 (Fab) | 0.078 | >70 |
| KL2B494 (Fab) | 0.053 | >70 |

KL2B413 scFv generated from the Ablexis immunization campaign had a thermal stability (Tm) of 67° C. as measured by Nano DSF and a binding affinity ($K_D$) to human hK2 of about 34 nM. Clone KL2B359 obtained for the re-humanization campaign and which had maintained a binding affinity similar to murine 11B6 was converted to scFv-Fc and CAR-T for additional profiling. KL2B359 scFv shows a Tm of 67° C., and a binding affinity ($K_D$) to hK2 of ~0.7-1 nM. KL2B30, KL2B242, KL2B53, KL2B467 and KL2B494 Fab showed binding affinities below 0.5 nM and Tm values above 70° C.

Epitope Mapping

The epitope and paratope of selected anti-hK2 antibodies and anti-hK2/CD3 bispecific antibodies were determined by hydrogen-deuterium exchange mass spectrometry (HDX-MS). Human KLK2 antigen was used for epitope and paratope mapping experiment.

Briefly, purified KLK2 antigen was incubated with and without anti-hK2 antibodies or anti-hK2/CD3 bispecific antibodies in deuterium oxide labeling buffer. The hydrogen-deuterium exchange (HDX) mixture was quenched at different time point by the addition of 8 M urea, 1M TCEP, pH 3.0. The quenched sample was passed over an immobilized pepsin/FPXIII column at 600 μL/min equilibrated with buffer A (1% acetonitrile, 0.1% FA in H2O) at room temperature. Peptic fragments were loaded onto a reverse phase trap column at 600 μL/min with buffer A and desalted for 1 min (600 μL buffer A). The desalted fragments were separated by a C18 column with a linear gradient of 8% to 35% buffer B (95% acetonitrile, 5% H2O, 0.0025% TFA) at 100 μL/min over 20 min and analyzed by mass spectrometry. Mass spectrometric analyses were carried out using an LTQ™ Orbitrap Fusion Lumos mass spectrometer (Thermo Fisher Scientific) with the capillary temperature at 275° C., resolution 150,000, and mass range (m/z) 300-1,800. BioPharma Finder 3.0 (Thermo Fisher Scientific) was used for the peptide identification of non-deuterated samples prior to the HDX experiments. HDExaminer version 2.5 (Sierra Analytics, Modesto, Calif.) was used to extract centroid values from the MS raw data files for the HDX experiments.

Incubation of hK2 antibodies, hu11B6, KL2B494, KL2B467, KL2B30, KL2B413 and KL2B53 with soluble hK2 protein resulted in different patterns of hydrogen exchange and overall protection. The protected segments were mapped onto the sequence of hK2 antigen to visualize the binding epitopes (FIG. 3). KL2B494, KL2B467 and KL2B30 bound to common sequences of (i) residues 174-178 (SEQ ID NO: 111, KVTEF) (e.g., KL2B494, KL2B467 and KL2B30 bound at least three of the residues of SEQ ID NO: 111, namely, the KVT residues at 174-176) and (ii) residues 230-234 (SEQ ID NO: 112, HYRKW) (e.g., KL2B494, KL2B467 and KL2B30 bound at least three of the residues of SEQ ID NO: 112, namely, the HYR residues at 230-232). KL2B413 also bound all residues of SEQ ID NO: 111 and the KW residues of SEQ ID NO: 112, as shown in FIG. 3. An embodiment of the present invention provides an isolated protein comprising an antigen binding domain that binds hK2, wherein said antigen binding domain binds to hK2 within epitopes having sequences of SEQ ID NO: 111 and SEQ ID NO: 112; for example, said antigen binding domain binds to all residues, or at least four residues, or at least three residues of SEQ ID NO: 111 and binds to all residues, or at least four residues, or at least three residues of SEQ ID NO: 112.

KL2B53 showed a different pattern of protection and bound to a sequence consisting of residues 27-32 (Seq ID NO: 113, SHGWAH), 60-75 (SEQ ID NO: 114, RHNLFEPEDTGQRVP) and 138-147 (SEQ ID NO: 115, GWGSIEPEE).

According to an embodiment, an isolated anti-hK2/anti-CD3 protein (e.g., hu11B6, KL2B494, KL2B467, KL2B30, KL2B413, or KL2B53) comprises an hk2-specific antigen binding domain that specifically binds to a discontinuous epitope (i.e., epitopes whose residues are distantly placed in the sequence) of hK2 comprising one or more amino acid sequences selected from the group consisting of SEQ ID NO: 111, 112, 113, 114, and 115.

The paratope of anti-hK2 antibodies h11B6, KL2B494, KL2B467, KL2B413 and anti-hK2/CD3 bispecific antibodies KLCB113 and KLCB80 were identified based on significant differences in deuterium uptake from the HDExaminer residue plots. KL2BB494 comprises three paratope regions two of which are located in the KL2B494 heavy chain variable domain (GFTFSH (SEQ ID NO: 455) and TAVYYCAKPHIVMVTAL (SEQ ID NO: 456)) and a single paratope region located within the light chain variable domain (YDDSDRPSGIPER (SEQ ID NO: 457)). KL2B467 comprises three paratope regions, two of which are located in the KL2B467 heavy chain variable domain (FTFSY (SEQ ID NO: 458) and GSYWAFDY (SEQ ID NO: 459)) and a single paratope region within the light chain variable domain (DNSD (SEQ ID NO: 460)). Hu11B6 comprises a single epitope region located in the heavy chain (GNSITSDYA (SEQ ID NO: 461)). KL2B413 comprises two paratope regions located in the heavy chain variable domain (GFTF (SEQ ID NO: 462) and ARDQNYDIL (SEQ ID NO: 463)). KL2B30 of bispecific KLCB80 comprise a paratope region locate in the heavy chain (comprising amino acid residues TIF and VTPNF (SEQ ID NO: 464)) and a paratope region located in the light chain (YAASTLQSG (SEQ ID NO: 465)). KL2B53 of bispecific KLCB113 comprise a single paratope region locate in the heavy chain (comprising amino acid residues ESGWSHY (SEQ ID NO: 466)). FIGS. 38A-38F show the binding paratope of these anti-hK2 antibodies and anti-hK2/CD3 bispecific antibodies (underlined sequences indicate CDR regions and highlighted sequences indicate paratope regions).

Example 4: Generation of Anti-CD3 Antibodies

Immunization

The generation of anti-CD3 antibody CD3B376 has been described in US20200048349.

Anti-CD3 antibodies were generated using Ablexis transgenic mouse platform. Ablexis mice were immunized with TRCW5 (SEQ ID NO: 338), including 13 Kappa mice and 12 Lambda mice. TRCW5 is comprised of the extracellular region of CD3δ fused by a 26 amino acid linker to the extracellular region of CD3ε as reported in Kim et al, JMB (2000) 302(4): 899-916. This polypeptide had at its C-terminus a human IgG1 Fc domain with a C-terminal Avi-tag used for site-specific biotinylation (Fairhead & Howarth, Methods Mol Biol (2015); 1266: 171-184).

```
TRCW5 (SEQ ID NO: 338):
FKIPIEELEDRVFVNCNTSITWVEGTVGTLLSDITRLDLGKRILDPRGIY

RCNGTDIYKDKESTVQVHYRMGSADDAKKDAAKKDDAKKDDAKKDGSDGN

EEMGGITQTPYKVSISGTTVILTCPQYPGSEILWQHNDKNIGGDEDDKNI

GSDEDHLSLKEFSELEQSGYYVCYPRGSKPEDANFYLYLRARVSPPSPAP

ELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPI

EKTISKAKGQPREPQVYTLPPSRDELTKNQVSLTCLVKGFYPSDIAVEWE

SNGQPENNYKTTPPVLDSDGSFFLYSKLTVDKSRWQQGNVFSCSVMHEAL

HNHYTQKSLSLSPGKGGGLNDIFEAQKIEWHE
```

Mice were immunized twice weekly for the duration of 7 weeks. On day 42, mice were boosted for hybridoma fusion by administration of 50 µg TRCW5 and 50 µg CD40 mAb spread over 8 sites, including 6 subcutaneous and 2 intradermal injections. For a final boost, mice received 20 µL injections of Jurkat cells, a T cell line which endogenously expresses the T cell receptor complex, including CD3ε (Schneider et al (1977) Int. J. Cancer, 19 (5): 621-6), at 4.74×107 cells/mL.

Lymph nodes and spleens were extracted from mice and fusions performed by cohorts. Lymph node cells were counted and combined in a 1:1 ratio with FO myeloma cells (ATCC (CRL-1646)) and incubated for 10 d at 37° C. prior to antibody screening. Supernatants from hybridoma fusion cells were then assayed by ELISA for binding to TRCW5 using TRCW5 either non-specifically immobilized on the plate (ELISA, Thermo cat. #34022) or by streptavidin conjugation to biotinylated-TRCW5 (SPARCL ELISA, Lumigen), according to manufacturers' instructions. ELISA assays were performed by coating plates with 0.5 ug/mL TRCW5 and 0.5 ug/mL HVEM-Fc (R&D cat. #365-HV) overnight @ 4° C. Plates were blocked by addition of 0.4% (w/v) bovine serum albumin (BSA) in phosphate-buffered saline (PBS) overnight @ 4° C. Plates were washed with 1×PBS supplemented with 0.02% (v/v) Tween 20. To each well, 50 uL of hybridoma supernatant was applied and incubated for 1 hr at room temperature. Bound antibody was detected by addition of goat anti-mouse IgG Fc conjugated to horseradish peroxidase (Jackson cat. #115-036-071) diluted 1:10,000 in blocking buffer followed by incubation for 30 min at room temperature. 3, 3', 5, 5'-tetramethylbenzidine (TMB) substrate buffer (Thermo cat. #34022) was added at 25 uL/well and incubated for 10 min in the dark. Reactions were stopped by addition of 25 uL/well of 4 M H2SO4. Luminescence was read at 450 nm using BioTek® Epoch2 Microplate Reader. Hits were selected having signal at least 3-fold higher than background.

The two assay formats resulted in 426 hits (264 hits from ELISA, 194 from SPARCL ELISA, 70 hits were identified in both assays). Of these 426 initial hits, 49 ELISA and 32 SPARCL ELISA hits were confirmed. The hybridoma fusions corresponding to the positive binders were refed and tested for their abilities to bind Jurkat cells, using flow cytometry. The results suggested that three antibodies, including clone 003_F12, clone 036_E10 and clone 065_D03, showed significant binding to Jurkat cells, endogenously expressing CD3, based on mean fluorescence index (MFI, see Table 4). While clones 003_F12 and 036_E10 (from human kappa mice) were confirmed positive for human kappa light chain by ELISA, clone 065_D03 (from human lambda mouse) was negative for human lambda. The variable genes of these three clones were then sequenced.

TABLE 15

| Mean fluorescence index (MFI) for binding of selected clones to Jurkat cells | |
|---|---|
| Clone ID | MFI (arbitrary units) |
| 003_F12 | 176147 |
| 036_E10 | 43133 |
| 065_D03 | 136269 |
| No Ab | 2075.61 |
| 10 nM UCHT1 | 89214.29 |

Figure 4B:
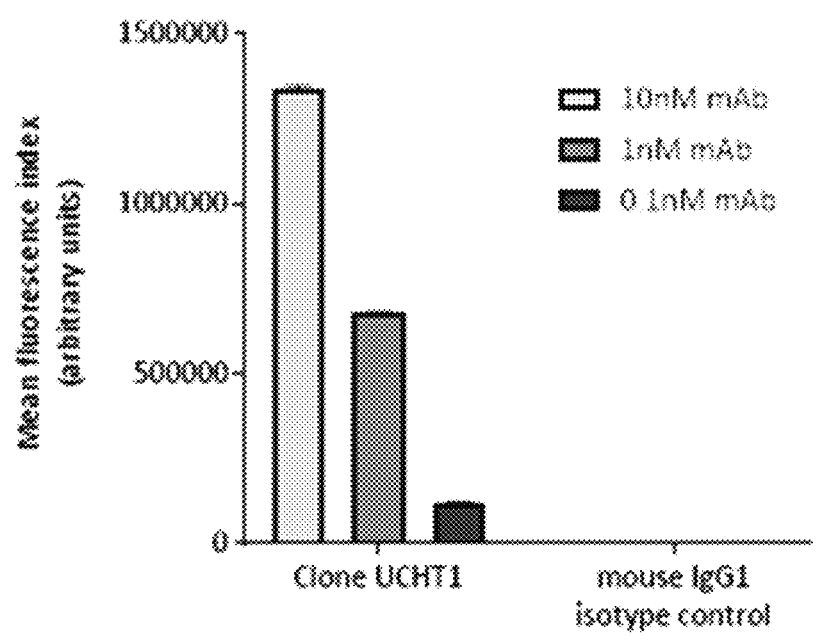

Next, these three clones were screened for their abilities to bind primary human and cyno T cells. Briefly, primary human and cyno pan T cells were resuspended at $1\times10^6$ cells/mL in flow staining buffer and cells were plated at 50,000 cells/well. To each well, 50 uL of hybridoma supernatant were added and the mixture was incubated on ice for 30 min. After incubation, 200 µL of staining buffer was added and cells were pelleted by centrifugation at 300×G for 5 min. Anti-mouse IgG conjugated to Alexa-647 was added at 2 µg/mL in staining buffer in 50 µL total volume and incubated for 30 min on ice. 150 μL of staining buffer was added and cells were pelleted by centrifugation at 300×G for 5 min. Cells were resuspended in 30 μL of running buffer containing 1:1,000-dilated Sytox green dead cell stain and run on iQue Screener. Cells were gated on FCS vs SCS to eliminate debris. Singlets were gated on SCS-A vs SCS-H, and from singlet population, live cells were chosen using BL1 channel for low-negative with Sytox green. CD3 binding was assessed by comparing test articles to negative control by RL1 (Alexa-647) geomeans. In this assay, clone 065_D03 showed the highest cell binding signal (FIG. 4A and FIG. 4B).

The variable region of the Clone 065_D03 was then cloned into an IgG1 backbone resulting in the antibody termed CD3B815 (sequences are shown in Table 16). CD31B815 was screened again for binding to Jurkat cells and showed positive binding to Jurkat cells.

TABLE 16

CD3B815 amino acid sequences.

| Protein | SEQ ID NO: | Amino acid sequences |
| --- | --- | --- |
| CD3B815 Heavy Chain | 262 | EVQLVESGGGLVKPGGSLRLSCAASGFTFSRYNMNWVRQAPGKGL EWVSSISTSSNYIYYADSVKGRFTFSRDNAKNSLDLQMSGLRAEDT AIYYCTRGWGPFDYWGQGTLVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKKVEPKSCDKTHTCPPCP APELLGGPSVFLEPPKPKDTLMISRTPEVTCVVVDVSHEDPEVKFN WYVDGVEVHNAKTKPREEQYNSTYRVVSVLTVLHQDWLNGKEY KCKVSNKALPAPIEKTISKAKGQPREPQVYFLPPSREEMTKNQVSLT CLVKGFYPSDIAVEWESNGQPENNYKTTPPVLDSDGSFFLYSKLTV DKSRWQQGNVFSCSVMHEALHNHYTQKSLSLSPGK |
| CD3B815 Light Chain | 265 | DILLTQSPGILSVSPGERVSFSCRARQSIGTAIHWYQQRTNGSPRLLI KYASESISGIPSRFSGSGSGTDFTLTINSVESEDIADYYCQQSNSWPY TFGGGTKLEIKRTVAAPSVFIEPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |

Humanization and scFv Formatting of CD3 Binding Domains

The light chain (LC) of the v-region of CD3B815 was humanized in scFv format. Briefly, the LC from CD3B815 was grafted onto the human IGKV1-39*01-IGKJ2*01 germline and two positions (Y49K and L78V) were identified for human to mouse back mutations. This resulted in variants, having either Y49K, L78V, or both Y49K and L78V. The LC from CD3B815 also contained an NS motif which presents a risk for deamidation at positions 92-93. Therefore, several variants generated also contained N92G. These variants and associated mutations are described in Table 17.

TABLE 17

Mutations in humanized scFv variants, defined according to Kabat numbering system.

| scFv identification | Description | VL mutations |
| --- | --- | --- |
| CD3W234 | CD3B815-HL-scFV, Contains mouse VL | none |
| CD3W238 | CDR of CD3B815 grafted into IGKV1D-39*01 | none |

TABLE 17-continued

Mutations in humanized scFv variants, defined according to Kabat numbering system.

| scFv identification | Description | VL mutations |
| --- | --- | --- |
| CD3W241 | CDR of CD3B815 grafted into IGKV1D-39*01 | L78V |
| CD3W242 | CDR of CD3B815 grafted into IGKV1D-39*01 | Y49K |
| CD3W243 | CDR of CD3B815 grafted into IGKV1D-39*01 | Y49K, L78V |
| CD3W244 | CDR of CD3B815 grafted into IGKV1D-39*01 | L78V, N92G |
| CD3W245 | CDR of CD3B815 grafted into IGKV1D-39*01 | Y49K, N92G |
| CD3W246 | CDR of CD3B815 grafted into IGKV1D-39*01 | Y49K, L78V, N92G |
| CD3W247 | CDR of CD3B815 grafted into IGKV1D-39*01 | N92G |

TABLE 17-continued

Mutations in humanized scFv variants, defined according to Kabat numbering system.

| scFv identification | Description | VL mutations |
| --- | --- | --- |
| CD3W248 | IGKV1D-39*01 CD3B815-HL-scFV, Contains mouse VL | N92G |

Table 18 shows the VH and the VL amino acid sequences of selected anti-CD3 antibodies. Table 19 shows the VH and the VL DNA sequences of selected anti-CD3 antibodies. Table 20 shows the Kabat HCDR1, HCDR2 and the HCDR3 amino acid sequences of selected anti-CD3 antibodies in Kabat delineation. Table 21 shows the Kabat LCDR1. LCDR2 and the LCDR3 amino acid sequences of selected anti-CD3 antibodies in Kabat delineation. Table 22 summarizes the CDRs, VH and VL sequences of selected CD3 antibodies. FIG. 6 shows the alignment of the VL region of CD31B815 CD3W244, CD3W245, CD3W246, and CD3W247.

TABLE 18

VH and VL amino acid sequences of selected anti-CD3 scFv variants.

| mAb | VH name | VH sequence | VH SEQ ID NO: | VL name | VL sequence | VL SEQ ID NO: |
|---|---|---|---|---|---|---|
| CD3B815 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGILVIVSS | 248 | CD3L372 | DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIK | 249 |
| CD3W244 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 248 | CD3L394 | DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK | 250 |
| CD3W245 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 248 | CD3L395 | DIQMIQSPSSLSASVGDRVTITCRARQSIGTAIHWYQQKPGKAPKLLIKYASESISGVPSRFSGSGSGTDFTLTISSVLQPEDFATYYCQQSGSWPYTFGQGTKLEIK | 251 |
| CD3W246 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 248 | CD3L396 | DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK | 252 |
| CD3W247 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 248 | CD3L397 | DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK | 253 |
| CD3W248 | CD3H488 | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS | 248 | CD3L398 | DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK | 254 |

TABLE 18-continued

VH and VL amino acid sequences of selected anti-CD3 scFv variants.

| mAb | VH name | VH sequence | VH SEQ ID NO: | VL name | VL sequence | VL SEQ ID NO: |
|---|---|---|---|---|---|---|
| CD3B376 | CD3H219 | QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS | 122 | CD3L150 | QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL | 123 |

TABLE 19

VH and VL nucleic acid sequences of the humanized scFv variants.

| Binding domain name | VH nucleic acid Sequence | VH SEQ ID NO: | VL nucleic acid sequence | VL SEQ ID NO: |
|---|---|---|---|---|
| CD3B815 | GAGGTGCAACTGGTGGAGTCTGGGGGAGGCCTGGTCAAGCCTGGGGGGTCCCTGAGACTCTCCTGTGCAGCCTCTGGATTCACCTTCAGTAGATATAACATGAACTGGGTCCGCCAGGCTCCAGGGAAGGGGCTGGAGTGGGTCTCATCCATTAGTACTAGTAGTAATTACATATACTACGCAGACTCAGTGAAGGGCCGATTCACCTTCTCCAGAGACAACGCCAAGAACTCACTGGATCTGCAAATGAGCGGCCTGAGAGCCGAGGACACGGCTATTTATVTACTGTACGAGAGGCTGGGGGCCTTTTGACTACTGGGGCCAGGGAACCCTGGTCACCGTCTCCTCA | 273 | GATATACTTCTTACCCAGAGTCCCGGCATCCTCTCCGTTAGCCCTGGGGAGAGAGTCTCATTCTCATGCCAGCCAGACAGTCAATTGGTACCGCAATACACTGGTATCAACAGCGGACCAATGGTTCTCCCCGACTTCTGATAAAGTACGCATCAGAATCAATTAGTGGAATACCATCAAGATTTAGTGGCTCAGGGAGTGGAACCGATTTTACTCTGACCATCAA.CTCAGTGGAATCTGAGGACATTGCCGACTACTACTGTCAACAAAGCAATAGTTGGCCATATACCTTCGGAGGCGGAACTAAATTGGAGATAAAA | 276 |
| CD3W244 | GAGGTGCAACTGGTGGAGTCTGGGGGAGGCCTGGTCAAGCCTGGGGGGTCCCTGAGACTCTCCTGTGCAGCCTCTGGATTCACCTTCAGTAGATATAACATGAACTGGGTCCGCCAGGCTCCAGGGAAGGGGCTGGAGTGGGTCTCATCCATTAGTACTAGTAGTAATTACATATACTACGCAGACTCAGTGAAGGGCCGATTCACCTTCTCCAGAGACAACGCCAAGAACTCACTGGATCTGCAAATGAGCGGCCTGAGAGCCGAGGACACGGCTATTTATTACTGTACGAGAGGCTGGGGGCCTTTTGACTACTGGGGCCAGGGAACCCTGGTCACCGTCTCCTCA | 273 | GACATCCAGATGACACAGTCACCTTCTAGTTTCTTCTGCTTCTGTAGGCGACCGTGTAACTATCACCTGTCGAGCCCGTCAAAGTATTGGTACTGCCATTCACTGGTACCAACAAAAACCTGGCAAAGCTCCAAAAACTCTTGATCTACTATGCCTCCGAAAGCATATCAGGGGTCCCAAGCAGATTCTCAGGCAGTGGCAGTGGCACTGACTTCACTCTCACCATTTCTAGCGTGCAACCAGAGGACTTCGCCACTTATTACTGCCAACAGTCAGGGAGCTGGCCCTACACCTTCGGCCAAGGTACAAAACTGGAGATCAAA | 277 |
| CD3W245 | GAGGTGCAACTGGTGGAGTCTGGGGGAGGCCTGGTCAAGCCTGGGGGGTCCCTGAGACTCTCCTGTGCAGCCTCTGGATTCA | 273 | GACATACAAATGACACAATCACCCTCTTCTCTTTCTGCAAGCGTTGGCGACCGTGTCACTATCACTTGTCGAGCCCGCCAGTCCATAGGTACT | 278 |

TABLE 19-continued

VH and VL nucleic acid sequences of the humanized scFv variants.

| Binding domain name | VH nucleic acid Sequence | VH SEQ ID NO: | VL nucleic acid sequence | VL SEQ ID NO: |
|---|---|---|---|---|
| | CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | | GCCATTCACTGGTATCAAC AGAAGCCTGGCAAGGCTC CCAAACTCCTGATTAAGTA TGCCAGCGAGAGCATTTC CGGCGTACCTTCAAGATTT TCCGGCTCCGGTAGTGGG ACAGATTTCACTCTCACTA TATCTAGCCTCAACCAGA AGATTTCGCCACTTACTAC TGTCAACAATCAGGTTCAT GGCCTTACACTTTCGGCCA GGGGACAAAATTGGAGAT CAAG | | |
| CD3W246 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 273 | GACATCCAAATGACTCAA TCACCTAGCAGCCTCTCCG CCTCCGTTGGAGATAGAG TGACAATAACTTGCCGAG CCCGGCAAAGTATCGGAA CTGCTATTCACTGGTATCA ACAAAAACCTGGAAAGGC ACCTAAGCTCTTGATTAAA TACGCTTCTGAGTCCATCT CCGGCGTGCCTTCACGATT CAGCGGCAGCGGTAGTGG TACTGACTTTACCCTCACT ATTAGTTCTGTTCAGCCAG AGGACTTCGCAACTTATTA CTGCCAACAGAGTGGTTC CTGGCCATACACTTTTGGC CAGGGGACTAAATTGGAA ATCAAA | 279 | |
| CD3W247 | GAGGTGCAACTGGTGG AGTCTGGGGGAGGCCT GGTCAAGCCTGGGGGG TCCCTGAGACTCTCCTG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | 273 | GACATCCAAATGACTCAA AGCCCCTCTAGTTTGAGTG CATCTGTAGGTGACCGGG TAACAATCACCTGCCGTGC CCGGCAAAGTATAGGTAC TGCAATCCACTGGTACCA GCAAAAACCCGGCAAAGC ACCAAAGCTGCTCATATA CTATGCTAGTGAGAGCATT TCTGGCGTTCCTAGTCGAT TTTCTGGATCAGGGAGTG GAACTGATTTTACACTGAC AATCAGCAGCCTCCAACC CGAAGACTTCGCCACCTA CTATTGTCAGCAGTCTGGG TCCTGGCCTTACACATTCG GTCAAGGAACTAAATTGG AGATCAAA | 280 | |
| CD3W248 | GAGGTGCAACTGGTGG AGTCTGGGGGAGGCCT GGTCAAGCCTGGGGGG TCCCTGAGACTCTCCFG TGCAGCCTCTGGATTCA CCTTCAGTAGATATAAC ATGAACTGGGTCCGCCA GGCTCCAGGGAAGGGG CTGGAGTGGGTCTCATC CATTAGTACTAGTAGTA ATTACATATACTACGCA GACTCAGTGAAGGGCC GATTCACCTTCTCCAGA | 273 | GACATTTTGCTGACACAG AGCCCTGGTATCCTCTCAG TCAGTCCAGGGGAACGCG TTTCATTTAGCTGCCGTGC TCGACAGAGCATTGGGAC CGCAATCCACTGGTACCA ACAAAGAACTAACGGTTC ACCACGGCTTTTGATTAAG TATGCCTCCGAATCCATCA GTGGCATTCCTAGTCGTTT TTCTGGATCAGGATCAGG CACCGACTTTACTCTCACA ATTAATAGTGTCGAAAGT | 281 | |

TABLE 19-continued

VH and VL nucleic acid sequences of the humanized scFv variants.

| Binding domain name | VH nucleic acid Sequence | VH SEQ ID NO: | VL nucleic acid sequence | VL SEQ ID NO: |
|---|---|---|---|---|
| | GACAACGCCAAGAACT CACTGGATCTGCAAATG AGCGGCCTGAGAGCCG AGGACACGGCTATTTAT TACTGTACGAGAGGCTG GGGGCCTTTTGACTACT GGGGCCAGGGAACCCT GGTCACCGTCTCCTCA | | GAGGACATTGCAGACTAT TATTGTCAGCAATCCGGTT CCTGGCCCTATACTTTTGG TGGTGGTACTAAGTTGGA AATTAAA | |
| CD3B376 | CAGGTGCAGCTGCAGC AGTCTGGCCCTAGACTC GTGCGGCCTTCCCAGAC CCTGTCTCTGACCTGTG CCATCTCCGGCGACTCC GTGTTCAACAACAACGC CGCCTGGTCCTGGATCC GGCAGAGCCCTTCTAGA GGCCTGGAATGGCTGG GCCGGACCTACTACCGG TCCAAGTGGCTGTACGA CTACGCCGTGTCCGTGA AGTCCCGGATCACCGTG AACCCTGACACCTCCCG GAACCAGTTCACCCTGC AGCTGAACTCCGTGACC CCTGAGGACACCGCCCT GTACTACTGCGCCAGAG GCTACTCcrcCTCCTTC GACTATTGGGGCCAGG GCACCCTCGTGACCGTG TCCTCT | 275 | AGTCTGCTCTGACCCAGCC TGCCTCCGTGTCTGGCTCT CCCGGCCAGTCCATCACC ATCAGCTGTACCGGCACCT CCTCCAACATCGGCACCTA CAAGTTCGTurcCTGGTAT CAGCAGCACCCCGACAAG GCCCCCAAAGTGCTGCTGT ACGAGGTGTCCAAGCGGC CCTCTGGCGTGTCCTCCAG ATTCTCCGGCTCCAAGTCT GGCAACACCGCCTCCCTG ACCATCAGCGGACTGCAG GCTGAGGACCAGGCCGAC TACCACTGTGTGTCCTACG CTGGCTCTGGCACCCTGCT GTTTGGCGGAGGCACCAA GCTGACCGTGCTG | 283 |

TABLE 20

HCDR1, HCDR2 and HCDR3 amino acid sequences of selected anti-CD3 scFv antibodies using Kabat delineation.

| mAb | HCDR1 | SEQ ID NO: | HCDR2 | SEQ ID NO: | HCDR3 | SEQ ID NO: |
|---|---|---|---|---|---|---|
| CD3B815 | RYNMN | 255 | SISTSSNYIYYADSVKG | 256 | GWGPFDY | 257 |
| CD3W244 | RYNMN | 255 | SISTSSNYIYYADSVKG | 256 | GWGPFDY | 257 |
| CD3W245 | RYNMN | 255 | SISTSSNYIYYADSVKG | 256 | GWGPFDY | 257 |
| CD3W246 | RYNMN | 255 | SISTSSNYIYYADSVKG | 256 | GWGPFDY | 257 |
| CD3W247 | RYNMN | 255 | SISTSSNYIYYADSVKG | 256 | GWGPFDY | 257 |
| CD3W248 | RYNMN | 255 | SISTSSNYIYYADSVKG | 256 | GWGPFDY | 257 |
| CD3B376 | NNNAAWS | 116 | RTYYRSKWLYDYAVSVKS | 117 | GYSSSFDY | 118 |

TABLE 21

LCDR1, LCDR2 and LCDR3 amino acid sequences of selected anti-CD3 say antibodies using Kabat delineation.

| mAb | LCDR1 | SEQ ID NO: | LCDR2 | SEQ ID NO: | LCDR3 | SEQ ID NO: |
| --- | --- | --- | --- | --- | --- | --- |
| CD3B815 | RARQSIGTAIH | 258 | YASESIS | 259 | QQSNSWPYT | 260 |
| CD3W244 | RARQSIGTAIH | 258 | YASESIS | 259 | QQSGSWPYT | 261 |
| CD3W245 | RARQSIGTAIH | 258 | YASESIS | 259 | QQSGSWPYT | 261 |
| CD3W246 | RARQSIGTAIH | 258 | YASESIS | 259 | QQSGSWPYT | 261 |
| CD3W247 | RARQSIGTAIH | 258 | YASESIS | 259 | QQSGSWPYT | 261 |
| CD3W248 | RARQSIGTAIH | 258 | YASESIS | 259 | QQSGSWPYT | 261 |
| CD3B376 | TGTSSNIGTYK | 119 | EVSKRPSFVS | 120 | VSYAGSGTLL | 121 |

TABLE 22

HCDR1, HCDR2, HCD3, LCD1; LCD2, LCD3, VH and VL of anti-CD3 antibodies

| Antibody | Region | Amino Acid sequence | SEQ ID NO: |
| --- | --- | --- | --- |
| CD3B815 | HCDR1 | RYNMN | 255 |
|  | HCDR2 | SISTSSNYTYYADSVKG | 256 |
|  | HCDR3 | GWGPFDY | 257 |
|  | LCDR1 | RARQSIGTAIH | 258 |
|  | LCDR2 | YASES1S | 259 |
|  | LCDR3 | QQSNSWPYT | 260 |
|  | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 248 |
|  | VL (CD3L372) | DILLTQSPGILSVSPGERVSFSCRARQSIGTAIHWYQQR TNGSPRLLIKYASESISGIPSRFSGSGSGTDFTLTINSVES EDIADYYCQQSNSWPYTFGGGTKLEIK | 249 |
| CD3W244 | HCDR1 | RYNMN | 255 |
|  | HCDR2 | SISTSSNYNYADSVKG | 256 |
|  | HCDR3 | GWGPFDY | 257 |
|  | LCDR1 | RARQSIGTAIH | 258 |
|  | LCDR2 | YASESIS | 259 |
|  | LCDR3 | QQSGSWPYT | 261 |
|  | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 248 |
|  | VL (CD3L394) | DIQMTQSPSSLSASVGDRVTITCRARQSIGTAIHWYQQ KPGKAPKLLIYYASESISGVPSRFSGSGSGTDFTLTISSV QPEDFATYYCQQSGSWPYTFGQGTKLEIK | 250 |
| CD3BW245 | HCDR1 | RYNMN | 255 |
|  | HCDR2 | SISTSSNYWYADSVKG | 256 |
|  | HCDR3 | GWGPFDY | 257 |
|  | LCDR1 | RARQSIGTAIH | 258 |
|  | LCDR2 | YASESIS | 259 |
|  | LCDR3 | QQSGSWPYT | 261 |
|  | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 248 |
|  | VL (CD3L395) | DIQMTQSPSSLSASVGDRVTITCRARQSIGTAIHWYQQ KPGKAPKLLIKYASESISGVPSRFSGSGSGTDFTLTISSL QPEDFATYYCQQSGSWPYTFGQGTKLEIK | 251 |
| CD3BW246 | HCDR1 | RYNMN | 255 |
|  | HCDR2 | SISTSSNYIYYADSVKG | 256 |
|  | HCDR3 | GWGPFDY | 257 |
|  | LCDR1 | RARQSIGTAIH | 258 |
|  | LCDR2 | YASESIS | 259 |
|  | LCDR3 | QQSGSWPYT | 261 |
|  | VH (CD3H488) | EVQLVESGGGLVKPGGSLRLSCAASGFTFSRYNMNW VRQAPGKGLEWVSSISTSSNYIYYADSVKGRFYFSRDN AKNSLDLQMSGLRAEDTAIYYCTRGWGPFDYWGQGT LVTVSS | 248 |

TABLE 22-continued

HCDR1, HCDR2, HCD3, LCD1; LCD2, LCD3, VH and VL of anti-CD3 antibodies

| Antibody | Region | Amino Acid sequence | SEQ ID NO: |
|---|---|---|---|
| | VL (CD3L396) | DIQMTQSPSSLSASVGDRVTITCRARQSIGTAIHWYQQ KPGKAPKLLIKYASESISGVPSRFSGSGSGTDFTLTISSV QPEDFATYYCQQSGSWPYTFGQGTKLEIK | 252 |
| CD3BW247 | HCDR1 | RYNMN | 255 |
| | HCDR2 | SISTSSNYIYYADSVKG | 256 |
| | HCDR3 | GWGPFDY | 257 |
| | LCDR1 | RARQSIGTAIH | 258 |
| | LCDR2 | YASESIS | 259 |
| | LCDR3 | QQSGSWPYT | 261 |
| | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 248 |
| | VL (CD3L397) | DIQMTQSPSSLSASVGDRVTITCRARQSIGTAIHWYQQ KPGKAPKLLIYYASESISGVPSRFSGSGSGTDFTLTISSL QPEDFATYYCQQSGSWPYTFGQGTKLEIK | 253 |
| CD3BW248 | HCDR1 | RYNMN | 255 |
| | HCDR2 | SISTSSNYIYYADSVKG | 256 |
| | HCDR3 | GWGPFDY | 257 |
| | LCDR1 | RARQSIGTAIH | 258 |
| | LCDR2 | YASESIS | 259 |
| | LCDR3 | QQSGSWPYT | 261 |
| | VH (CD3H488) | EVQLVESGGGLVKPGGSLRLSCAASGFTFSRYNMNW VRQAPGKGLEWVSSISTSSNYIYYADSVKGRFTFSRDN AKNSLDLQMSGLRAEDTAIYYCTRGWGPFDYWGQGT LVTVSS | 248 |
| | VL (CD3L398) | DILLTQSPGILSVSPGERVSFSCRARQSIGTAIHWYQQR TNGSPRLLIKYASESISGIPSRFSGSGSGTDFTLTINSVES EDIADYYCQQSGSWPYTFGGGTKLEIK | 254 |
| CD3B376 | HCDR1 | NNNAAWS | 116 |
| | HCDR2 | RTYYRSKWLYDYAVSVKS | 117 |
| | HCDR3 | GYSSSFDY | 118 |
| | LCDR1 | TGTSSNIGTYKFVS | 119 |
| | LCDR2 | EVSKRPS | 120 |
| | LCDR3 | VSYAGSGTLL | 121 |
| | VH (CD3H219) | QVQLQQSGPRLVRPSQTLSLTCAISGDSVFNNNAAWS WIRQSPSRGLEWLGRTYYRSKWLYDYAVSVKSRITVN PDTSRNQFTLQLNSVTPEDTALYYCARGYSSSFDYWG QGTLVTVSS | 122 |
| | VL (CD3L150) | QSALTQPASVSGSPGQSITISCTGTSSNIGTYKFNSWYQ QHPDKAPKVLLYEVSKRPSGVSSRFSGSKSGNTASLTI SGLQAEDQADYHCVSYAGSGTLLFGGGTKLTVL | 123 |

Consensus Sequence

FIG. 6 shows the alignment of the VL regions of CD3B815, CD3W244, CD3W245, CD3W246 and CD3W247. HCDR and LCDR residues are underlined. A consensus amino acid sequence of SEQ ID NO: 157 was determined for the VL region and.

SEQ ID NO: 157
DIQX$_1$TQSPX$_2$X$_3$LSX$_4$SX$_5$GX$_6$RVX$_7$X$_8$X$_9$CRARQSIGTAIHWYQK

X$_{10}$X$_{11}$X$_{12}$X$_{13}$PX$_{14}$LLIX$_{15}$YASESISGX$_{16}$PSRFSGSGSGTDFTL

TIX$_{17}$SX$_{18}$QX$_{19}$EDX$_{20}$AX$_{21}$YYCQQSX$_{22}$SWPYTFGX$_{23}$GTKLEIK wherein, X$_1$ is L or M; X$_2$ is G or S; X$_3$ is I or S; X$_4$ is V or A; X$_5$ is P or V; X$_6$ is E or D; X$_7$ is S or T; X$_8$ is F or I; X$_9$ is S or T; X$_{10}$ is T or P; X$_{11}$ is N or G; X$_{12}$ is G or K; X$_{13}$ is S or A; X$_{14}$ is R or K; X$_{15}$ is K or Y; X$_{16}$ is I or V; X$_{17}$ is N or S; X$_{18}$ is V or L; X$_{19}$ is S or P; X$_{20}$ is I or F; X$_{21}$ is D or T; X$_{22}$ is N or G; or X$_{21}$ is G or Q.

Binding of Humanized Anti-CD3 scFv Variants to CD3 after Heat Shock.

The variable regions of the anti-CD3 molecules were formatted as scFv in VH-linker-VL orientation using linker GTEGKSSGSGSESKST (SEQ ID NO: 108) for expression in E. coli, and then screened for binding to recombinant CD3 (homodimeric CD3εγ-Fc, CD3W147, SEQ ID NO: 339), binding to T cells, and thermostability.

CD3W147 (SEQ ID NO: 339):
QDGNEEMGGITQTPYKVSISGTTVILTCPQYPGSEILWQHNDKNIGGDED
DKNIGSDEDHLSLKEFSELEQSGYYVCYPRGSKPEDANFYLYLRARVGSA
DDAKKDAAKKDDAKKDDAKKDGSQSIKGNHLVKVYDYQEDGSVLLTCDAE
AKNITWFKDGKMIGFLTEDKKKWNLGSNAKDPRGMYQCKGSQNKSKPLQV
YYRMGSGSLGGPSVFLFPPKPKDTLMISRTPEVTCVVVDVSQEDPEVQFN
WYVDGVEVHNAKTKPREEQFNSTYRVVSVLTVLHQDWLNGKEYKCKVSNK
GLPSSIEKTISKAKGQPREPQVYTFPPSQEEMTKNQVSLRCLVKGFYPSD
IAVEWESNGQPENNYKTTKPVLDSDGSFRLESRLTVDKSRWQEGNVFSCS
VMHEALHNHYTQKSLSLSGGHHHHHH

Briefly, scFv-coding sequences were cloned into a pADL™-22c vector having a PelB leader sequence for secretion. E. coli cells were transformed with plasmid and grown overnight at 37° C. in 2×YT microbial growth medium supplemented with 100 μg/mL Carbenicillin. Protein expression was induced by addition of 1 mM IPTG and cultures were grown overnight. After expression, cells were pelleted by centrifugation at 2,200×g for 5 min and supernatants were collected and tested directly for binding to biotinylated CD3W147 by ELISA.

The sequences of the scFv-HL proteins expressed in *E. coli* are shown in Table 24.

TABLE 24 scFv-HL *E. coli* amino acid sequences.

| scFv | SEQ ID NO: | Amino acid sequence |
|---|---|---|
| CD3W234-HL-E.c. | 342 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDILLTQSPGILSVSPGERV SFSCRARQSIGTAIHWYQQRTNGSPRLLIKYASESISGIP SRFSGSGSGTDFTLTINSVESEDIADYYCQQSNSWPYTF GGGTKLEIKGPGGQHHHHHGAYPYDVPDYAS |
| CD3W238-HL-E.c. | 343 | EVQLVESGGGLVKPGGSLRLSCAASGFTFSRYNMNWV RQAPGKGLEWVSSISTSSNYTYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSLQPEDFATYYCQQSNSWPY TFGQGTKLEIKGPGGQHHHHHGAYPYDVPDYAS |
| CDW242-HL-E.c. | 344 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSLQPEDFATYYCQQSNSWPY TFGQGTKLEIKGPGGQHHHHHGAYPYDVPDYAS |
| CD3W243-HL-E.c. | 345 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIYYASESISG VPSRFSGSGSGTDFTLTISSVQPEDFATYYCQQSNSWPY TFGQGTKLEIKGPGGQHHHHHGAYPYDVPDYAS |
| CD3W244-HL-E.c. | 346 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPCIKAPKLLIYYASESISG VPSRFSGSGSGTDFTLTISSVQPEDFATYYCQQSGSWPY TFGQGTKLEIKGPGGQHHHHHGAYPYDVPDYAS |
| CD3W245-HL-E.c. | 347 | EVQLVESGGGLVKPGGSLRLSCAASGFTFSRYNMNWV RQAPGKGLEWVSSISISSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSLQPEDFATYYCQQSGSWPY TFGQGTKLEIKGPGGQHHHHHGAYPYDVPDYAS |
| CD3W246-HL-E.c. | 348 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDIQMTQSPSSLSASVGDR VTITCRARQSIGTAIHWYQQKPGKAPKLLIKYASESISG VPSRFSGSGSGTDFTLTISSVQPEDFATYYCQQSGSWPY TFGQGTKLEIKGPGGQHHHHHGAYPYDVPDYAS |
| CD3W247-HL-E.c. | 349 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYAVGQGTL VTVSSGTEGKSSGSGSESKSTDIQMTQSPSSLSASVGDR VTITCRARQSIGTAIHWYQQKPGKAPKLLIYYASESISG VPSRFSGSGSGTDFTLTISSLQPEDFATYYCQQSGSWPY TFGQGTKLEIKGPGGQHHHHHGAYPYDVPDYAS |
| CD3W248-HL-E.c. | 350 | EVQLVESGGGLVKPGGSLRLSCAASGFTFSRYNMNWV RQAPGKGLEWVSSISTSSNYIYYADSVKGRFTFSRDNA KNSLDLQMSGLRAEDTAIYYCTRGWGPFDYWGQGTL VTVSSGTEGKSSGSGSESKSTDILLTQSPGILSVSPGERV |

TABLE 24-continued scFv-HL *E. coli* amino acid sequences.

| scFv | SEQ ID NO: | Amino acid sequence |
|------|------------|---------------------|
|      |            | SFSCRARQSIGTAIHWYQQRTNGSPRLLIKYASESTSGIP SRFSGSGSGTDFTLTINSVESEDIADYYCQQSGSWPYTF GGGTKLEIKGPGGQHHHHHHGAYPYDVPDYAS |

Figure 5:
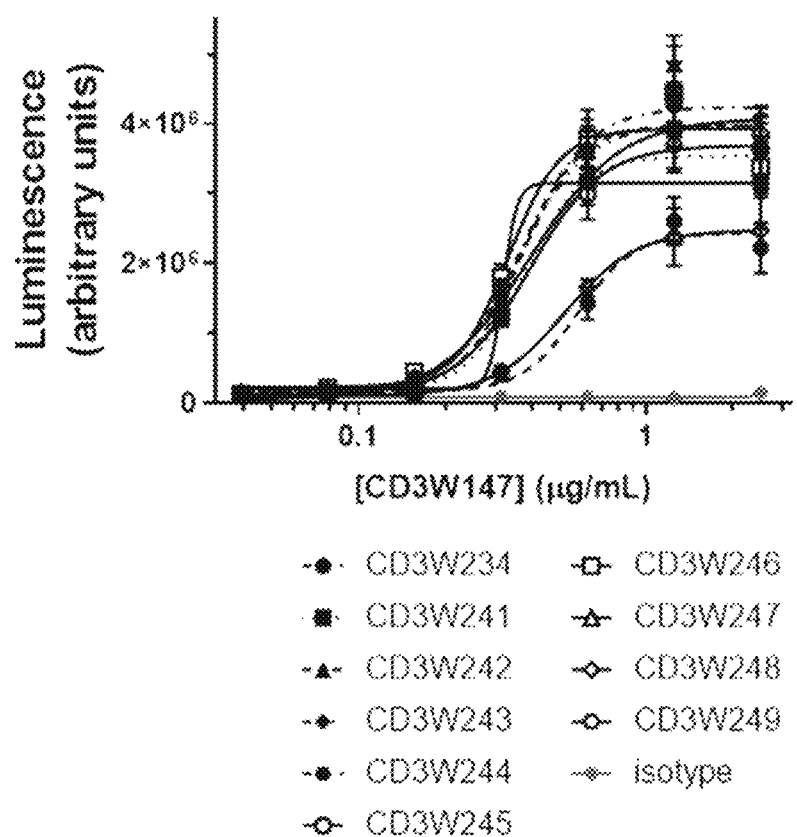
FIG. 5 shows binding of anti-CD3 scFv variants, expressed in E. coli, to CD3.

The binding of the anti-CD3 scFv variants to CD3 was determined by ELISA. Biotinylated CD3W147 (SEQ ID NO: 339) was immobilized on the plate in concentrations ranging from 0.039 μg/mL to 2.5 μg/mL in 2-fold dilutions followed by incubation at room temperature for 45 min. Bound scFv was detected using chicken anti-HA-horseradish peroxidase and then detected with chemiluminescence substrate. All tested scFv molecules derived from CD3B815 bound CD3ε (FIG. 5).

The scFv molecules were then tested for their abilities to bind T cells, using flow cytometry. Briefly, human T cells were thawed and resuspended into flow staining buffer at 1×10^6 cells/ml and plated at 50,000 cells/well. A positive control, CD3W36 comprised of an anti-CD3 antibody SP34 formatted as \scFv-LH, and a negative control, B23, an scFv targeted against the F-glycoprotein from respiratory syncytial virus, were used for comparison. *E. coli* supernatants were added at 150 μL/well and incubated at 4° C. for 1 hr. After incubation, plates were washed with staining buffer and detected with anti-His antibody conjugated to Alexa-647 in staining buffer. After incubation, 200 μL of IntelliCyt running buffer was added to the mixture, and cells were resuspended in 30 μL running buffer containing 1:1,000 Sytox Green dead cell stain and analyzed on iQue Screener. Gating and analysis were performed as above. All scFv molecules derived from CD3B815 displayed mean fluorescence indices consistent with T cell binding (Table 25).

TABLE 25

T cell-based binding of humanized scFv molecules.

| Protein | MFI (n = 2) |
|---------|-------------|
| CD3W245-HL-E.c. | 178140.0 |
| CD3W244-HL-E.c. | 165631.0 |
| CD3W246-HL-E.c. | 153895.8 |
| CD3W238-HL-E.c. | 137380.4 |
| CD3W242-HL-E.c. | 126105.9 |
| CD3W243-HL-E.c. | 111347.6 |
| CD3W241-HL-E.c. | 120793.8 |
| CD3W247-HL-E.c. | 110932.3 |
| CD3W248-HL-E.c. | 60437.1 |
| CD3W234-HL-E.c. | 66790.3 |
| B23 | 51.8 |
| CD3W36 | 99451.6 |

Epitope Identification

The epitope on CD3 was determined by hydrogen-deuterium exchange mass spectrometry (HDX-MS). The antibody clone OKT3 was used as a control for the HDX experiment, since its epitope on CD3ε was known from crystal structure (PDB ID 1SY6) (Kjer-Nielsen, L. et al.; *Proc Natl Acad Sci USA* 101, 7675-7680).

On-Exchange Experiment for HDX-MS. On-exchange reaction was initiated by mixing 10 μL of 10 μM CD3W220 (SEQ ID NO: 340), which was comprised of CD3εγ fused with a 26-aa linker region fused onto a serum albumin domain, with or without 1.2 molar-excess of ligand and 30 μL of H₂O or a deuterated buffer (20 mM MES, pH 6.4, 150 mM NaCl in 95% D2O or 20 mM Tris, pH 8.4, 150 mM NaCl in 95% D2O). The reaction mixture was incubated for 15, 50, 150, 500, or 1,500 s at 1.2° C. The on-exchanged solution was quenched by the addition of chilled 40 μL of 8 M urea, 1 M TCEP, pH 3.0 and immediately analyzed.

CD3W220 (CD3εγ-HSA-6xHis) (SEQ ID NO: 340):
QDGNEEMGGITQTPYKVSISGTTVILTCPQYPGSEILWQHNDKNIGGDED
DKNIGSDEDHLSLKEFSELEQSGYYVCYPRGSKPEDANFYLYLRARVGSA
DDAKKDAAKKDDAKKDDAKKDGSQSIKGNHLVKVYDYQEDGSVLLTCDAE
AKNITWFKDGKMIGFLTEDKKKWNLGSNAKDPRGMYQCKGSQNKSKPLQV
YYRMGGGSDAHKSEVAHRFKDLGEENFKALVLIAFAQYLQQSPFEDHVKL
VNEVTEFAKTCVADESAENCDKSLHTLFGDKLCTVATLRETYGEMADCCA
KQEPERNECFLQHKDDNPNLPRLVRPEVDVMCTAFHDNEETFLKKYLYEI
ARRHPYFYAPELLFFAKRYKAAFTECCQAADKAACLLPKLDELRDEGKAS
SAKQRLKCASLQKFGERAFKAWAVARLSQRFPKAEFAEVSKLVTDLTKVH
TECCHGDLLECADDRADLAKYICENQDSISSKLKECCEKPLLEKSHCIAE
VENDEMPADLPSLAADFVESKDVCKNYAEAKTYVTIGMFINEYARRHPDY
SVVLLLRIAKTYETTLEKCCAAADPHECYAKVFDEFKPLVEEPQNLIKQN
CELFEQLGEYKFQNALLVRYTKKVPQVSTPTLVEVSRNLGKVGSKCCKHP
EAKRMPCAEDYLSVVLNQLCVLHEKTPVSDRVTKCCTESLVNRRPCFSAL
EVDETYVPKEFNAETFTFHADICTLSEKERQIKKQTALVELVKHKPKATK
EQLKAVMDDFAAFVEKCCKADDKETCFAEEGKKLVAASQAALGLGGGSHH
HHHHHH

General Procedure for HDX-MS Data Acquisition. HDX-MS sample preparation was performed with automated HDx system (LEAP Technologies, Morrisville, N.C.). The columns and pump were; protease, protease type XIII (protease from *Aspergillus saitoi*, type XIII)/pepsin column (w/w, 1:1; 2.1×30 mm) (NovaBioAssays Inc., Woburn, Mass.); trap, ACQUITY UPLC BEH C18 VanGuard Pre-column (2.1×5 mm) (Waters, Milford, Mass.), analytical, Accucore C18 (2.1×100 mm) (Thermo Fisher Scientific, Waltham, Mass.); and LC pump, VH-P10-A (Thermo Fisher Scientific). The loading pump (from the protease column to the trap column) was set at 600 μL/min with 99% water, 1% acetonitrile, 0.1% formic acid. The gradient pump (from the trap column to the analytical column) was set from 8% to 28% acetonitrile in 0.1% aqueous formic acid in 20 min at 100 μL/min.

MS Data Acquisition. Mass spectrometric analyses were carried out using an LTQ™ Orbitrap Fusion Lumos mass spectrometer (Thermo Fisher Scientific) with the capillary temperature at 275° C., resolution 150,000, and mass range (m/z) 300-1,800.

HDX-MS Data Extraction. BioPharma Finder 3.0 (Thermo Fisher Scientific) was used for the peptide identification of non-deuterated samples prior to the HDX experiments. HDExaminer version 2.5 (Sierra Analytics, Modesto, Calif.) was used to extract centroid values from the MS raw data files for the HDX experiments.

HDX-MS Data Analysis. The extracted HDX-MS data were further analyzed in Excel. All exchange time points (at pH 6.4 or pH 8.4 at 1.2° C.) were converted to the equivalent time points at pH 7.4 and 23° C. (e.g., 15 s at pH 6.4 at 1.2° C. is equivalent of 0.15 s at pH 7.4 at 23° C.; Table 23).

TABLE 23

HDX reaction conditions and exchange times versus exchange times corrected to pH 7.4 and 23° C.

| Time adjusted to pH 7.4, 23° C. (s) | pH 6.4 1.2° C. (s) | pH 8.4 1.2° C. (s) |
|---|---|---|
| 0.015 | — | — |
| 0.05 | — | — |
| 0.15 | 15 | — |
| 0.5 | 50 | — |
| 1.5 | 150 | — |
| 5 | 500 | — |
| 15 | 1,500 | 15 |
| 50 | — | 50 |
| 150 | — | 150 |
| 500 | — | 500 |
| 1,500 | — | 1,500 |

Results. Incubation of KLCB91, the bispecific antibodies comprising CD3W245 as an anti-CD3 arm described in Example 5, with recombinant CD3ε (SEQ ID NO: 340) resulted in different patterns of overall protection and degrees of protection at specific segments of the antigen. KLCB91 and OKT3 both protected non-continuous segments (FIG. 7) indicating conformational non-identical epitopes. The protected segments were mapped onto the crystal structure of CD3ε (PDB 1SY6) to visualize the binding epitopes in three dimensions.

Figure 7:
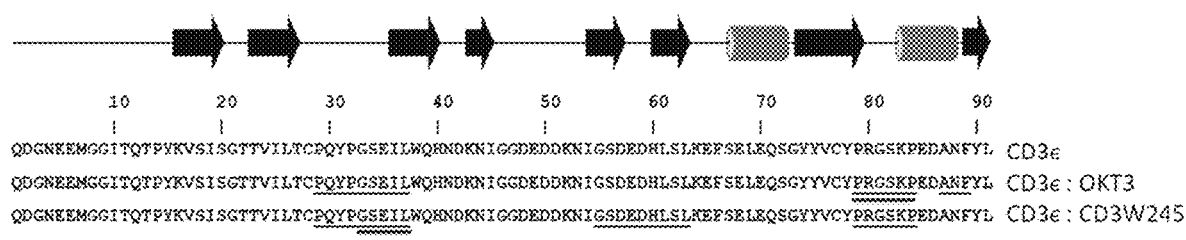
FIG. 7 shows hydrogen-deuterium exchange mass spectrometry (HDX-MS) of CD3W245 bound to human CD3ε (CD3ε:CD3W245) and OKT3 bound to CD3ε (CD3ε:OKT). The amino acid sequence shown represent residues 2-93 of the 105 residues of the ECD domain of CD3ε and corresponds to residue 1-91 of CD3ε SEQ ID NO: 340 Single underline indicates segments with 10%-30% decrease in deuteration levels and double underline indicates segments with >30% decrease in deuteration levels in the presence of the antibody, as compared to CD3ε alone.

Consistent with the crystal structure of OKT3 bound to CD3ε (Uniprot ID P07766), the epitope of OKT3 was found to consist of peptides covering spanning residues 29-37, 79-84, and 87-89 of CD3ε (SEQ ID NO: 340 and FIG. 7). CD3W245 bound to an epitope partially overlapping with that of OKT3, and included amino acid residues 29-37 (PQYPGSEIL, SEQ ID NO 341), 55-63 (GSDEDHLSL, SEQ ID NO:448), and 79-84 (PRGSKP, SEQ ID NO: 449) of CD3ε SEQ ID NO: 340 (FIG. 7).

Example 5: Generation of Bispecific hK2×CD3 Antibodies

The VH/VL regions of the anti-hK2 antibodies generated in Example 1-3 and the VH/VL regions of the anti-CD3 antibody of Example 4 were engineered into bispecific format and expressed as IgG1.

Engineering of CD3 scFvs for hK2/CD3 Bispecific Generation

CD3 VH/VL regions were engineered as scFvs in either VH-Linker-VL or VL-linker-VH orientations using the linker of SEQ ID NO: 7 (Table 1). Amino acid sequences of anti-CD3 molecules in scFv format are shown in Table 26. The VH-Linker-VL or VL-linker-VH scFv molecules binding CD3 were further engineered into a scFv-hinge-CH2-CH3 format comprising Fc silencing mutation (L234A/L235A/D265S) and the T350V/L351Y/F405A/Y407V mutations designed to promote selective heterodimerization. The polypeptide of SEQ ID NO: 109 was used as the constant domain hinge-CH2-CH3. Amino acid sequences of anti-CD3 molecules in scFv-hinge-CH2-CH3 format (scFv-Fc) are shown in Table 27. DNA SEQ ID NO: of anti-CD3 molecules in scFv format and scFv-hinge-CH2-CH3 format (scFv-Fc) are shown in Table 28.

```
(huIgG1_G1m(17)-hinge-Fc_C220S_AAS_ZWA)
                                      SEQ ID NO: 109
EPKSSDKTHTCPPCPAPEAAGGPSVFLFTPKPKDTLMISRTPEVTCVVVS

VSHEDPEVKFNWYVDGVEVHNAKTKPREEQYNSTYRVVSVLTVLHQDWLN

GKEYKCKVSNKALPAPIEKTISKAKGQPREPQVYVYPPSREEMTKNQVSL

TCLVKGFYPSDIAVEWESNGQPENNYKTTPPVLDSDGSFALVSKLTVDKS

RWQQGNVFSCSVMHEALENHYTQKSLSLSPG
```

TABLE 26

| ScFv sequences of selected anti-CD3 antibodies ||||
|---|---|---|---|
| scFv name | Acronym | Amino acid Sequence of scFv | SEQ ID NO: |
| ScFv29 | CD3W244_HL | ENQLVESGGGLVKPGGSLRLSCAASGFTFSRYNMWVRQ APGKGLEWVSSISTSSNYTYYADSVKGRFTFSRDNAKNSLD LQMSGLRAEDTAIYYCTRGWGPFDYWGQGTLVTVSSGGS EGKSSGSGSESKSTGGSDIQMTQSPSSLSASVGDRVTITCRA RQSIGTAIHWYQQKPGKAPKWYYASESISGVPSRFSGSGS GTDFTLTISSVQPEDFATYYCQQSGSWPYTFGQGTKLEIK | 328 |
| scfv30 | CD3W244_LH | DIQMTQSPSSLSASVGDRVTITCRARQSIGTAIHWYQQKPG KAPKLLIYYASESISGVPSRFSGSGSGTDFTLTISSVQPEDFA TYYCQQSGSWPYTFGQGTKLEIKGGSEGKSSGSGSESKSTG GSEVQLVESGGGLVKPGGSLRLSCAASGFTFSRYNMWVR QAPGKGLEWVSSISTSSNYIYYADSVKGRFTFSRDNAKNSL DLQMSGLRAEDTAIYYCTRGWGPFDYWGQGTLVTVSS | 329 |
| scFv31 | CD3W245_HL | EVQLVESGGGLVKPGGSLRLSCAASGFTFSRYNMWVRQ APGKGLEWVSSISTSSNYIYYADSVKGRFTFSRDNAKNSLD LQMSGLRAEDTAIYYCTRGWGPFDYWGQGTLVFVSSGGS EGKSSGSGSESKSTGGSDIQMTQSPSSLSASVGDRVTITCRA RQSIGTAIHWYQQKPGKAPKLLIKYASESISGVPSRFSGSGS GTDFTLTISSLQPEDFATYYCQQSGSWPYTFGQGTKLEIK | 330 |

TABLE 26-continued

ScFv sequences of selected anti-CD3 antibodies

| scFv name | Acronym | Amino acid Sequence of scFv | SEQ ID NO: |
|---|---|---|---|
| scFv32 | CD3W245_LH | DIQMTQSPSSLSASVGDRVTITCRARQSIGTAIHWYQQKPG KAPKLLIKYASESISGVPSRFSGSGSGIDFILTISSLQPEDFA TYYCQQSGSWPYTFGQGTKLEIKGGSEGKSSGSGSESKSTG GSEVQLVESGGGLVKPGGSLRLSCAASGFTFSRYNMNWVR QAPGKGLEWVSSLSTSSNYIYYADSVKGRFTFSRDNAKNSL DLQMSGLRAEDTAIYYCTRCGPFDYWGQGTLNTVSS | 331 |
| scFv33 | CD3W246_HL | EVQLVESGGGLVKPGGSLRLSCAASGFTFSRYNMNWVRQ APGKGLEWVSSISTSSNYIYYADSVKGRFTFSRDNAKNSLD LQMSGLRAEDTAIYYCTRGWGPFDYWGQGTLVTVSSGGS EGKSSGSGSESKSTGGSDIQMTQSPSSLSASVGDRVTITCRA RQSIGTAIHWYQQKPGKAPKLLIKYASESISGVPSRFSGSGS GTDFTLTISSVQPEDFATYYCQQSGSWPYTFGQGTKLEIK | 332 |
| scFv34 | CD3W246_LH | DIQMTQSPSSLSASVGDRVTITCRARQSIGTATHWYQQKPG KAPKLLIKYASESISGVPSRFSGSGSGTDFTLTISSVQPEDFA TYYCQQSGSWPYTFGQGTKLEIKGGSEGKSSGSGSESKSTG GSEVQLVESGGGLVKPGGSLRLSCAASGFTFSRYNMNWVR QAPGKGLEWVSSISTSSNYIYYADSVKGRFTFSRDNAKNSL DLQMSGLRAEDTAIYYCTRGWGPFDYWGQGTLVTVSS | 333 |
| scFv35 | CD3W247_HL | EVQLVESGGGLVKPGGSLRLSCAASGFTFSRYNMNWVRQ APGKGLEWVSSISTSSNYIYYADSVKGRFTFSRDNAKNSLD LQMSGLRAEDTAIYYCTRGWGPFDYWGQGTLVTVSSGGS EGKSSGSGSESKSTGGSDIQMTQSPSSLSASVGDRVTITCRA RQSIGTAIHWYQQKPGKAPKLLIYYASESISGVPSRFSGSGS GTDFTLTISSLQPEDFATYYCQQSGSWPYTFGQGTKLEIK | 334 |
| scFv36 | CD3W247_LH | DIQMTQSPSSLSASVGDRVTITCRARQSIGTAIHWYQQKPG KAPKLLIYYASESISGVPSRFSGSGSGTDFTLTISSLQPEDFA TYYCQQSGSWPYTFGQGTKLEIKGGSEGKSSGSGSESKSTG GSEVQLVESGGGLVKPGGSLRLSCAASGFTFSRYNMNWVR QAPGKGLEWVSSISTSSNYIYYADSVKGRFTFSRDNAKNSL DLQMSGLRAEDTAIYYCTRGWGPFDYWGQGTLVTVSS | 335 |
| scFv37 | CD3W248_HL | ENQLVEESGGGLVKPGGSLRLSCAASGFTFSRYNMNWVRQ APGKGLEWVSSISTSSNYTYYADSVKGRFTFSRDNAKNSLD LQMSGLRAEDTAIYYCTRGWGPFDYWGQGTLVTVSSGGS EGKSSGSGSESKSTGGSDILLTQSPGILSVSPGERVSFSCRAR QSIGTAIHWYQQRTNGSPRLLIKYASESISGIPSRFSGSGSGT DFTLTINSVESEDIADYYCQQSGSWPYTFGGGTKLEIK | 336 |
| scFv38 | CD3W248_LH | DILLTQSPGILSVSPGERVSFSCRARQSIGTAIHWYQQRTNG SPRLLIKYASESISGIPSRFSGSGSGTDFTLTINSVESEDIADY YCQQSGSWPYTFGGGTKLEIKGGSEGKSSGSGSESKSTGGS EVQLVESGGGLVKPGGSLRLSCAASGFTFSRYNMNWVRQ APGKGLEWVSSISTSSNYTYYADSVKGRFTFSRDNAKNSLD LQMSGLRAEDTAIYYCTRGWGPFDYWGQGTLVTVSS | 337 |

TABLE 27

SEQ ID NOs and amino acid sequences of scFv-Fc (scFv-hinge CH2-CH3) anti-CD3 antibodies

| scFv name | Antibody Name | scFv-Fc (scFv-hinge CH2-CH3) amino acid sequences | SEQ ID NO: |
|---|---|---|---|
| scFv29 | CD3W244-HL-Fc | EVQLVESGGGLVKPGGSLRLSCAASGFTFSRYNMNWVRQAP GKGLEWVSSISTSSNYIYYADSVKGRFTFSRDNAKNSLDLQM SGLRAEDTAIYYCTRGWGPFDYWGQGTLNTVSSGGSEGKSS GSGSESKSTGGSDIQMTQSPSSLSASVGDRYTITCRARQSIGT AIHWYQQKPGKAPKLLIYYASESISGVPSRFSGSGSGTDFTLTI SSVQPEDFATYYCQQSGSWPYTFGQGTKLEIKEPKSSDKTHT CPPCPAPEAAGGPSVFLFPPKPKDTLMISRTPEVTCVVVSVSH EDPEVKFNWYVDGVEVHNAKTKPREEQYNSTYRNVVSVLTVL HQDWLNGKEYKCKVSNKALPAPIEKTISKAKGQPREPQVYV YPPSREEMTKNQVSLTCLVKGFYPSDIAVEWESNGQPENNYK TTPPVLDSDGSFALVSKLTVTDKSRWQQGNVFSCSVMHEALH NHYTQKSLSLSPGK | 326 |

TABLE 27-continued

SEQ ID NOs and amino acid sequences of scFv-Fc
(scFv-hinge CH2-CH3) anti-CD3 antibodies

| scFv name | Antibody Name | scFv-Fc (scFv-hinge CH2-CH3) amino acid sequences | SEQ ID NO: |
|---|---|---|---|
| scFv30 | CD3W244-LH-Fc | DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRESCAASGFTFSRYNMNWVRQAPGKGLEWVSSISTSSNYIYYADSVKGRFTFSRDNAKNSLDLQMSGLRAEDTAIYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK | 327 |
| scFv31 | CD3W245-HL-Fc | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK | 375 |
| scFv32 | CD3W245-LH-Fc | DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK | 376 |
| scFv33 | CD3W246-HL-Fc | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK | 377 |
| scFv34 | CD3W246-LH-Fc | DIQMTQSPSSLSASVGDRVTITCRARQSIGTAIHWYQQKPGKAPKLLIKYASESISGVPSRFSGSGSGTDFTLTISSVQPEDFATYYCQQSGSWPVITGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK | 453 |
| scFv35 | CD3W247-HL-Fc | EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRESGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSH | 379 |

TABLE 27-continued

SEQ ID NOs and amino acid sequences of scFv-Fc
(scFv-hinge CH2-CH3) anti-CD3 antibodies

| scFv name | Antibody Name | scFv-Fc (scFv-hinge CH2-CH3) amino acid sequences | SEQ ID NO: |
|---|---|---|---|
| | | EDPEVKFNWYVDGVEVHNAKTKPREEQYNSTYRVVSVLTVL HQDWLNGKEYKCKVSNKALPAPIEKTISKAKGQPREPQVYV YPPSREEMTKNQVSLTCLVKGFYPSDIAVEWESNGQPENNYK TIPPVLDSDGSFALVSKLTVDKSRWQQGNVFSCSVMHEALH NHYTQKSLSLSPGK | |
| scFv36 | CD3W247-LH-Fc | DIQMTQSPSSLSASVGDRVTITCRARQSIGTAIHWYQQKPGKA PKLLIYYASESISGVPSRFSGSGSGTDFTLTISSLQPEDFATYYC QQSGSWPYTFGQGTKLEIKGGSEGKSSGSGSESKSTGGSEVQ LVESGGGLVKPGGSLRLSCAASGFTFSRYNMNWVPQAPGKG LEWVSSISTSSNYIYYADSVKGRFTFSRDNAKNSLDLQMSGL RAEDTAIYYCTRGWGPFDYWGQGTLVTVSSEPKSSDKTHTC PPCPAPEAAGGPSVFLFPPKPKDTLMISRTPEVTCVVVSVSHE DPEVKFNWYVDGVEVHNAKTKPPEEQYNSTYRVVSVLTVL HQDWLNGKEYKCKVSNKALPAPIEKTISKAKGQPREPQVYV YPPSREEMTKNQVSLTCLVKGFNTSDIAVEWESNGQPENNYK TTPPVLDSDGSFALVSKLTVDKSRWQQGNVFSCSVMHEALH NHYTQKSLSLSPGK | 380 |
| scFv37 | CD3W248-HL-Fc | EVQLVESGGGLVKPGGSLRLSCAASGFTFSRYNMNWVRQAP GKGLEWVSSISTSSNYIYYADSVKGRFTFSRDNAKNSLDLQM SGLRAEDTAIYYCTRGWGPFDYWGQGTLVTVSSGGSEGKSS GSGSESKSTGGSDILLTQSPGILSVSPGERVSFSCRARQSIGTAI HWYQQRTNGSPRLLIKYASESISGIPSRFSGSGSGIDFTLTINS VESEDIADYYCQQSGSWPYTFGGGTKLEIKEPKSSDKTHTCPP CPAPEAAGGPSVFLEPPKPKDTLMISRTPEVTCVVVSVSHEDP EVKFNWYVDGVEVHNAKTKPREEQYNSTYRVVSVLTVLHQ DWLNGKEYKCKVSNKALPAPIEKTISKAKGQPREPQVYVYPP SREEMTKNQVSLTCLVKGFYPSDIAVEWESNGQPENNYKTTP PVLDSDGSFALVSKLTVDKSRWQQGNVFSCSVMHEALHNHY TQKSLSLSPGK | 381 |
| scFv38 | CD3W248-LH-Fc | DILLTQSPGILSVSPGERVSFSCRARQSIGTAIHWYQQRTNGSP RLLIKYASESISGIPSRSGSGSGTDFTLTINSVESEDIADYYCQ QSGSWPYTFGGGTKLEIKGGSEGKSSGSGSESKSTGGSEVQL VESGGGLVKPGGSLRLSCAASGMTSRYNNINWVRQAPGKGL EWVSSISTSSNYIYYADSVKGRFTFSRDNAKNSLDLQMSGLR AEDTAIYYCTRGWGPFDYWGQGTLVTVSSEPKSSDKTHTCPP CPAPEAAGGPSVFLFPPKPKDTLMISRTPEVTCVVVSVSHEDP EVKFNWYVDGVEVHNAKTKPREEQYNSTYRVVSVLTVLHQ DWLNGKEYKCKVSNKALPAPIEKTISKAKGQPREPQVYVYPP SREEMTKNQVSLTCLVKGFYPSDIAVEWESNGQPENNYKTTP PVLDSDGSFALVSKLTVDKSRWQQGMTSCSWHEALHNHY TQKSLSLSPGK | 382 |

TABLE 28

DNA SEQ ID NOs of anti-CD3 antibodies in scFv
and scFv-hinge-CH2-CH3 (scFv-Fc) format

| Antibody Name | scFv DNA SEQ ID NO | scFv-Fc DNA SEQ ID NO |
|---|---|---|
| CD3W244_HL | 384 | 394 |
| CD3W244_LH | 385 | 395 |
| CD3W245_HL | 386 | 396 |
| CD3W245_LH | 387 | 397 |
| CD3W246_HL | 388 | 398 |
| CD3W246_LH | 389 | 399 |
| CD3W247_HL | 390 | 400 |
| CD3W247_LH | 391 | 401 |
| CD3W248_HL | 392 | 402 |
| CD3W248_LH | 393 | 403 |

(CD3W244_HL scFv)

SEQ ID NO: 384

GAGGTGCAGCTGGTGGAGAGCGGTGGCGGTCTGGTGAAGCCAGGTGGCAGCCTGCGCCTGA

GCTGTGCCGCCAGCGGTTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCGTGCAGCCAGAGGACTTCGCCACCTACTACTGCCA

GCAGAGCGGCAGCTGGCCATACACCTTCGGCCAGGGCACCAAGCTGGAGATCAAG (CD3W244_LH scFv)
SEQ ID NO: 385
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGC (CD3W245_HL scFv)
SEQ ID NO: 386
GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACcrrcAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CAAGTACGCCAGCGAGAGCATCAGCGGTGTGCCAAGCCGCTTCAGCGGCAGCGGCAGCGGC

ACCGACTTCACCCTGACCATCAGCAGCCTGCAGCCAGAGGACTTCGCCACCTACTACTGCCA

GCAGAGCGGCAGCTGGCCATACACCTTCGGCCAGGGCACCAAGCTGGAGATCAAG (CD3W245_LH scFv)
SEQ ID NO: 387
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCcmAcCATCAGCAGCCTGCAGCCAGAGGA

-continued

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGC (CD3W246_HL scFv)

SEQ ID NO: 388

GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CAAGTACGCCAGCGAGAGCATCAGCGGTGTGCCAAGCCGCTTCAGCGGCAGCGGCAGCGGC

ACCGACTTCACCCTGACCATCAGCAGCGTGCAGCCAGAGGACTTCGCCACCTACTACTGCCA

GCAGAGCGGCAGCTGGCCATACACCTTCGGCCAGGGCACCAAGCTGGAGATCAAG (CD3W246_LH scFv)

SEQ ID NO: 389

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGC (CD3W247_HL scFv)

SEQ ID NO: 390

GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

-continued

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCCTGCAGCCAGAGGACTTCGCCACCTACTACTGCCA

GCAGAGCGGCAGCTGGCCATACACCTTCGGCCAGGGCACCAAGCTGGAGATCAAG (CD3W247_LH scFv)
SEQ ID NO: 391
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACCTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGC (CD3W248_HL scFv)
SEQ ID NO: 392
GAGGTGCAACTGGTGGAGTCTGGGGGAGGCCTGGTCAAGCCTGGGGGGTCCCTGAGACTCT

CCTGTGCAGCCTCTGGATTCACCTTCAGTAGATATAACATGAACTGGGTCCGCCAGGCTCCA

GGGAAGGGGCTGGAGTGGGTCTCATCCATTAGTACTAGTAGTAATTACATATACTACGCAGA

CTCAGTGAAGGGCCGATTCACCTTCTCCAGAGACAACGCCAAGAACTCACTGGATCTGCAAA

TGAGCGGCCTGAGAGCCGAGGACACGGCTATTTATTACTGTACGAGAGGCTGGGGGCCTTTT

GACTACTGGGGCCAGGGAACCCTGGTCACCGTCTCCTCAGGCGGATCTGAGGGAAAGTCCA

GCGGCTCCGGCAGCGAAAGCAAGTCCACCGGCGGAAGCGACATCTTGCTGACTCAGTCTCC

AGGCATCCTGTCTGTGAGTCCAGGAGAAAGAGTCAGTTTCTCCTGCAGGGCCAGACAGAGC

ATTGGCACAGCCATACACTGGTATCAGCAAAGAACAAATGGTTCTCCAAGGCTTCTCATAAA

GTATGCTTCTGAGTCTATCTCTGGGATCCCTTCCAGGTTTAGCGGCAGTGGATCAGGGACAG

ATTTTACTCTTACCATCAACAGTGTGGAGTCTGAAGATATTGCAGATTATTACTGTCAACAA

AGTGGGAGCTGGCCGTACACGTTCGGAGGGGGGACCAAGCTGGAAATAAAA (CD3W248_LH scFv)
SEQ ID NO: 393
GACATCTTGCTGACTCAGTCTCCAGGCATCCTGTCTGTGAGTCCAGGAGAAAGAGTCAGTTT

CTCCTGCAGGGCCAGACAGAGCATTGGCACAGCCATACACTGGTATCAGCAAAGAACAAAT

GGTTCTCCAAGGCTTCTCATAAAGTATGCTTCTGAGTCTATCTCTGGGATCCCTTCCAGGTTT

AGCGGCAGTGGATCAGGGACAGATTTTACTCTTACCATCAACAGTGTGGAGTCTGAAGATAT

TGCAGATTATTACTGTCAACAAAGTGGGAGCTGGCCGTACACGTTCGGAGGGGGGACCAAG

CTGGAAATAAAAGGCGGATCTGAGGGAAAGTCCAGCGGCTCCGGCAGCGAAAGCAAGTCCA

CCGGCGGAAGCGAGGTGCAACTGGTGGAGTCTGGGGGAGGCCTGGTCAAGCCTGGGGGGTC

-continued

CCTGAGACTCTCCTGTGCAGCCTCTGGATTCACCTTCAGTAGATATAACATGAACTGGGTCC

GCCAGGCTCCAGGGAAGGGGCTGGAGTGGGTCTCATCCATTAGTACTAGTAGTAATTACATA

TACTACGCAGACTCAGTGAAGGGCCGATTCACCTTCTCCAGAGACAACGCCAAGAACTCACT

GGATCTGCAAATGAGCGGCCTGAGAGCCGAGGACACGGCTATTTATTACTGTACGAGAGGC

TGGGGGCCTTTTGACTACTGGGGCCAGGGAACCCTGGTCACCGTCTCCTCA (CD3W244_HL-scFv-Fc)

SEQ ID NO: 394

GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCGTGCAGCCAGAGGACTTCGCCACCTACTACTGCCA

GCAGAGCGGCAGCTGGCCATACACCTTCGGCCAGGGCACCAAGCTGGAGATCAAGGAGCCC

AAATCTAGCGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA (CD3W244_LH-scFv-Fc)

SEQ ID NO: 395

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

-continued

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGCGAGCCCA

AATCTAGCGACAAAACTCACACATGTCCACCGTGCCCAGCACCTGAAGCAGCAGGGGGACC

GTCAGTCTTCCTCTTCCCCCCAAAACCCAAGGACACCCTCATGATCTCCCGGACCCCTGAGG

TCACATGCGTGGTGGTGAGCGTGAGCCACGAAGACCCTGAGGTCAAGTTCAACTGGTACGT

GGACGGCGTGGAGGTGCATAATGCCAAGACAAAGCCGCGGGAGGAGCAGTACAACAGCAC

GTACCGTGTGGTCAGCGTCCTCACCGTCCTGCACCAGGACTGGCTGAATGGCAAGGAGTACA

AGTGCAAGGTCTCCAACAAAGCCCTCCCAGCCCCCATCGAGAAAACCATCTCCAAAGCCAA

AGGGCAGCCCCGAGAACCACAGGTGTACGTGTACCCCCCATCCCGGGAGGAGATGACCAAG

AACCAGGTCAGCCTGACCTGCCTGGTCAAAGGCTTCTATCCCAGCGACATCGCCGTGGAGTG

GGAGAGCAATGGGCAGCCGGAGAACAACTACAAGACCACGCCTCCCGTGCTGGACTCCGAC

GGCTCCTTCGCCCTCGTGAGCAAGCTCACCGTGGACAAGTCTAGATGGCAGCAGGGGAACG

TCTTCTCATGCTCCGTGATGCATGAGGCTCTGCACAACCACTACACGCAGAAGAGCCTCTCC

CTGTCTCCGGGTAAA (CD3W245_HL-scFv-Fc)                                         SEQ ID NO: 396

GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCAC CAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCCAAAGCTGCTGAT

CAAGTACGCCAGCGAGAGCATCAGCGGTGTGCCAAGCCGCTTCAGCGGCAGCGGCAGCGGC

ACCGACTTCACCCTGACCATCAGCAGCCTGCAGCCAGAGGACTTCGCCACCTACTACTGCCA

GCAGAGCGGCAGCTGGCCATACACCTTCGGCCAGGGCACCAAGCTGGAGATCAAGGAGCCC

AAATCTAGCGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA (CD3W245_LH-scFv-Fc)

SEQ ID NO: 397

GACATCCAGATGACCCAGAGCCCAAGCAGCCTGAGCGCCAGCGTCGGCGACCGCGTGACCA
TCACCTGTCGTGCCCGCCAGAGCATCGGCACCGCCATCCACTGGTACCAGCAGAAGCCAGGC
AAGGCCCCAAAGCTGCTGATCAAGTACGCCAGCGAGAGCATCAGCGGTGTGCCAAGCCGCT
TCAGCGGCAGCGGCAGCGGCACCGACTTCACCCTGACCATCAGCAGCCTGCAGCCAGAGGA
CTTCGCCACCTACTACTGCCAGCAGAGCGGCAGCTGGCCATACACCTTCGGCCAGGGCACCA
AGCTGGAGATCAAGGGCGGATCTGAGGGAAAGTCCAGCGGCTCCGGCAGCGAAAGCAAGTC
CACCGGCGGAAGCGAGGTGCAGCTGGTGGAGAGCGGTGGCGGTCTGGTGAAGCCAGGTGGC
AGCCTGCGCCTGAGCTGTGCCGCCAGCGGTTTCACCTTCAGCCGCTACAACATGAACTGGGT
GCGCCAAGCCCCAGGCAAGGGCCTGGAGTGGGTGAGCAGCATCAGCACCAGCAGCAACTAC
ATCTACTACGCCGACAGCGTGAAGGGCCGCTTCACCTTCAGCCGCGACAACGCCAAGAACA
GCCTGGACCTGCAGATGAGCGGTCTGCGCGCCGAGGACACCGCCATCTACTACTGCACCCGC
GGTTGGGGCCCATTCGACTACTGGGGCCAGGGCACCCTGGTGACCGTGAGCAGCGAGCCCA
AATCTAGCGACAAAACTCACACATGTCCACCGTGCCCAGCACCTGAAGCAGCAGGGGGACC
GTCAGTCTTCCTCTTCCCCCCAAAACCCAAGGACACCCTCATGATCTCCCGGACCCCTGAGG
TCACATGCGTGGTGGTGAGCGTGAGCCACGAAGACCCTGAGGTCAAGTTCAACTGGTACGT
GGACGGCGTGGAGGTGCATAATGCCAAGACAAAGCCGCGGGAGGAGCAGTACAACAGCAC
GTACCGTGTGGTCAGCGTCCTCACCGTCCTGCACCAGGACTGGCTGAATGGCAAGGAGTACA
AGTGCAAGGTCTCCAACAAAGCCCTCCCAGCCCCCATCGAGAAAACCATCTCCAAAGCCAA
AGGGCAGCCCCGAGAACCACAGGTGTACGTGTACCCCCCATCCCGGGAGGAGATGACCAAG
AACCAGGTCAGCCTGACCTGCCTGGTCAAAGGCTTCTATCCCAGCGACATCGCCGTGGAGTG
GGAGAGCAATGGGCAGCCGGAGAACAACTACAAGACCACGCCTCCCGTGCTGGACTCCGAC
GGCTCCTTCGCCCTCGTGAGCAAGCTCACCGTGGACAAGTCTAGATGGCAGCAGGGGAACG
TCTTCTCATGCTCCGTGATGCATGAGGCTCTGCACAACCACTACACGCAGAAGAGCCTCTCC
CTGTCTCCGGGTAAA (CD3W246_HL-scFv-Fc)

SEQ ID NO: 398

GAGGTGCAGCTGGTGGAGAGCGGTGGCGGTCTGGTGAAGCCAGGTGGCAGCCTGCGCCTGA
GCTGTGCCGCCAGCGGTTTCACCTTCAGCCGCTACAACATGAACTGGGTGCGCCAAGCCCCA
GGCAAGGGCCTGGAGTGGGTGAGCAGCATCAGCACCAGCAGCAACTACATCTACTACGCCG
ACAGCGTGAAGGGCCGCTTCACCTTCAGCCGCGACAACGCCAAGAACAGCCTGGACCTGCA
GATGAGCGGTCTGCGCGCCGAGGACACCGCCATCTACTACTGCACCCGCGGTTGGGGCCCAT
TCGACTACTGGGGCCAGGGCACCCTGGTGACCGTGAGCAGCGGCGGATCTGAGGGAAAGTC
CAGCGGCTCCGGCAGCGAAAGCAAGTCCACCGGCGGAAGCGACATCCAGATGACCCAGAGC
CCAAGCAGCCTGAGCGCCAGCGTCGGCGACCGCGTGACCATCACCTGTCGTGCCCGCCAGA
GCATCGGCACCGCCATCCACTGGTACCAGCAGAAGCCAGGCAAGGCCCCAAAGCTGCTGAT
CAAGTACGCCAGCGAGAGCATCAGCGGTGTGCCAAGCCGCTTCAGCGGCAGCGGCAGCGGC
ACCGACTTCACCCTGACCATCAGCAGCGTGCAGCCAGAGGACTTCGCCACCTACTACTGCCA
GCAGAGCGGCAGCTGGCCATACACCTTCGGCCAGGGCACCAAGCTGGAGATCAAGGAGCCC
AAATCTAGCGACAAAACTCACACATGTCCACCGTGCCCAGCACCTGAAGCAGCAGGGGGAC
CGTCAGTCTTCCTCTTCCCCCCAAAACCCAAGGACACCCTCATGATCTCCCGGACCCCTGAG

```
GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA (CD3W246_LH-scFv-Fc)
                                                       SEQ ID NO: 399
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGCGAGCCCA

AATCTAGCGACAAAACTCACACATGTCCACCGTGCCCAGCACCTGAAGCAGCAGGGGGACC

GTCAGTCTTCCTCTTCCCCCCAAAACCCAAGGACACCCTCATGATCTCCCGGACCCCTGAGG

TCACATGCGTGGTGGTGAGCGTGAGCCACGAAGACCCTGAGGTCAAGTTCAACTGGTACGT

GGACGGCGTGGAGGTGCATAATGCCAAGACAAAGCCGCGGGAGGAGCAGTACAACAGCAC

GTACCGTGTGGTCAGCGTCCTCACCGTCCTGCACCAGGACTGGCTGAATGGCAAGGAGTACA

AGTGCAAGGTCTCCAACAAAGCCCTCCCAGCCCCCATCGAGAAAACCATCTCCAAAGCCAA

AGGGCAGCCCCGAGAACCACAGGTGTACGTGTACCCCCCATCCCGGGAGGAGATGACCAAG

AACCAGGTCAGCCTGACCTGCCTGGTCAAAGGCTTCTATCCCAGCGACATCGCCGTGGAGTG

GGAGAGCAATGGGCAGCCGGAGAACAACTACAAGACCACGCCTCCCGTGCTGGACTCCGAC

GGCTCCTTCGCCCTCGTGAGCAAGCTCACCGTGGACAAGTCTAGATGGCAGCAGGGGAACG

TCTTCTCATGCTCCGTGATGCATGAGGCTCTGCACAACCACTACACGCAGAAGAGCCTCTCC

CTGTCTCCGGGTAAA (CD3W247_HL-scFv-Fc)
                                                       SEQ ID NO: 400
GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT
```

-continued

TCGACTACTGGGGCCAGGGCACCCTGGTGACCGTGAGCAGCGGCGGATCTGAGGGAAAGTC

CAGCGGCTCCGGCAGCGAAAGCAAGTCCACCGGCGGAAGCGACATCCAGATGACCCAGAGC

CCAAGCAGCCTGAGCGCCAGCGTCGGCGACCGCGTGACCATCACCTGTCGTGCCCGCCAGA

GCATCGGCACCGCCATCCACTGGTACCAGCAGAAGCCAGGCAAGGCCCCAAAGCTGCTGAT

CTACTACGCCAGCGAGAGCATCAGCGGTGTGCCAAGCCGCTTCAGCGGCAGCGGCAGCGGC

ACCGACTTCACCCTGACCATCAGCAGCCTGCAGCCAGAGGACTTCGCCACCTACTACTGCCA

GCAGAGCGGCAGCTGGCCATACACCTTCGGCCAGGGCACCAAGCTGGAGATCAAGGAGCCC

AAATCTAGCGACAAAACTCACACATGTCCACCGTGCCCAGCACCTGAAGCAGCAGGGGGAC

CGTCAGTCTTCCTCTTCCCCCCAAAACCCAAGGACACCCTCATGATCTCCCGGACCCCTGAG

GTCACATGCGTGGTGGTGAGCGTGAGCCACGAAGACCCTGAGGTCAAGTTCAACTGGTACG

TGGACGGCGTGGAGGTGCATAATGCCAAGACAAAGCCGCGGGAGGAGCAGTACAACAGCA

CGTACCGTGTGGTCAGCGTCCTCACCGTCCTGCACCAGGACTGGCTGAATGGCAAGGAGTAC

AAGTGCAAGGTCTCCAACAAAGCCCTCCCAGCCCCCATCGAGAAAACCATCTCCAAAGCCA

AAGGGCAGCCCCGAGAACCACAGGTGTACGTGTACCCCCCATCCCGGGAGGAGATGACCAA

GAACCAGGTCAGCCTGACCTGCCTGGTCAAAGGCTTCTATCCCAGCGACATCGCCGTGGAGT

GGGAGAGCAATGGGCAGCCGGAGAACAACTACAAGACCACGCCTCCCGTGCTGGACTCCGA

CGGCTCCTTCGCCCTCGTGAGCAAGCTCACCGTGGACAAGTCTAGATGGCAGCAGGGGAAC

GTCTTCTCATGCTCCGTGATGCATGAGGCTCTGCACAACCACTACACGCAGAAGAGCCTCTC

CCTGTCTCCGGGTAAA (CD3W247_LH-scFv-Fc)                                                      SEQ ID NO: 401

GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGGGCGGATCTGAGGGAAAGTCCAGCGGCTCCGGCAGCGAAAGCAAGTC

CACCGGCGGAAGCGAGGTGCAGCTGGTGGAGAGCGGTGGCGGTCTGGTGAAGCCAGGTGGC

AGCCTGCGCCTGAGCTGTGCCGCCAGCGGTTTCACCTTCAGCCGCTACAACATGAACTGGGT

GCGCCAAGCCCCAGGCAAGGGCCTGGAGTGGGTGAGCAGCATCAGCACCAGCAGCAACTAC

ATCTACTACGCCGACAGCGTGAAGGGCCGCTTCACCTTCAGCCGCGACAACGCCAAGAACA

GCCTGGACCTGCAGATGAGCGGTCTGCGCGCCGAGGACACCGCCATCTACTACTGCACCCGC

GGTTGGGGCCCATTCGACTACTGGGGCCAGGGCACCCTGGTGACCGTGAGCAGCGAGCCCA

AATCTAGCGACAAAACTCACACATGTCCACCGTGCCCAGCACCTGAAGCAGCAGGGGGACC

GTCAGTCTFCCTCTTCCCCCCAAAACCCAAGGACACCCTCATGATCTCCCGGACCCCTGAGG

TCACATGCGTGGTGGTGAGCGTGAGCCACGAAGACCCTGAGGTCAAGTTCAACTGGTACGT

GGACGGCGTGGAGGTGCATAATGCCAAGACAAAGCCGCGGGAGGAGCAGTACAACAGCAC

GTACCGTGTGGTCAGCGTCCTCACCGTCCTGCACCAGGACTGGCTGAATGGCAAGGAGTACA

AGTGCAAGGTCTCCAACAAAGCCCTCCCAGCCCCCATCGAGAAAACCATCTCCAAAGCCAA

AGGGCAGCCCCGAGAACCACAGGTGTACGTGTACCCCCCATCCCGGGAGGAGATGACCAAG

AACCAGGTCAGCCTGACCTGCCTGGTCAAAGGCTTCTATCCCAGCGACATCGCCGTGGAGTG

-continued

GGAGAGCAATGGGCAGCCGGAGAACAACTACAAGACCACGCCTCCCGTGCTGGACTCCGAC

GGCTCCTTCGCCCTCGTGAGCAAGCTCACCGTGGACAAGTCTAGATGGCAGCAGGGGAACG

TCTTCTCATGCTCCGTGATGCATGAGGCTCTGCACAACCACTACACGCAGAAGAGCCTCTCC

CTGTCTCCGGGTAAA (CD3W248_HL-scFv-Fc)

SEQ ID NO: 402

GAGGTGCAACTGGTGGAGTCTGGGGGAGGCCTGGTCAAGCCTGGGGGGTCCCTGAGACTCT

CCTGTGCAGCCTCTGGATTCACCTTCAGTAGATATAACATGAACTGGGTCCGCCAGGCTCCA

GGGAAGGGGCTGGAGTGGGTCTCATCCATTAGTACTAGTAGTAATTACATATACTACGCAGA

CTCAGTGAAGGGCCGATTCACCTTCTCCAGAGACAACGCCAAGAACTCACTGGATCTGCAAA

TGAGCGGCCTGAGAGCCGAGGACACGGCTATTTATTACTGTACGAGAGGCTGGGGGCCTTTT

GACTACTGGGGCCAGGGAACCCTGGTCACCGTCTCCTCAGGCGGATCTGAGGGAAAGTCCA

GCGGCTCCGGCAGCGAAAGCAAGTCCACCGGCGGAAGCGACATCTTGCTGACTCAGTCTCC

AGGCATCCTGTCTGTGAGTCCAGGAGAAAGAGTCAGTTTCTCCTGCAGGGCCAGACAGAGC

ATTGGCACAGCCATACACTGGTATCAGCAAAGAACAAATGGTTCTCCAAGGCTTCTCATAAA

GTATGCTTCTGAGTCTATCTCTGGGATCCCTTCCAGGTTTAGCGGCAGTGGATCAGGGACAG

ATTTTACTCTTACCATCAACAGTGTGGAGTCTGAAGATATTGCAGATTATTACTGTCAACAA

AGTGGGAGCTGGCCGTACACGTTCGGAGGGGGGACCAAGCTGGAAATAAAAGAGCCCAAAT

CTAGCGACAAAACTCACACATGTCCACCGTGCCCAGCACCTGAAGCAGCAGGGGGACCGTC

AGTCTTCCTCTTCCCCCCAAAACCCAAGGACACCCTCATGATCTCCCGGACCCCTGAGGTCA

CATGCGTGGTGGTGAGCGTGAGCCACGAAGACCCTGAGGTCAAGTTCAACTGGTACGTGGA

CGGCGTGGAGGTGCATAATGCCAAGACAAAGCCGCGGGAGGAGCAGTACAACAGCACGTA

CCGTGTGGTCAGCGTCCTCACCGTCCTGCACCAGGACTGGCTGAATGGCAAGGAGTACAAGT

GCAAGGTCTCCAACAAAGCCCTCCCAGCCCCCATCGAGAAAACCATCTCCAAAGCCAAAGG

GCAGCCCCGAGAACCACAGGTGTACGTGTACCCCCCATCCCGGGAGGAGATGACCAAGAAC

CAGGTCAGCCTGACCTGCCTGGTCAAAGGCTTCTATCCCAGCGACATCGCCGTGGAGTGGGA

GAGCAATGGGCAGCCGGAGAACAACTACAAGACCACGCCTCCCGTGCTGGACTCCGACGGC

TCCTTCGCCCTCGTGAGCAAGCTCACCGTGGACAAGTCTAGATGGCAGCAGGGGAACGTCTT

CTCATGCTCCGTGATGCATGAGGCTCTGCACAACCACTACACGCAGAAGAGCCTCTCCCTGT

CTCCGGGTAAA (CD3W248_LH-scFv-Fc)

SEQ ID NO: 403

GACATCTTGCTGACTCAGTCTCCAGGCATCCTGTCTGTGAGTCCAGGAGAAAGAGTCAGTTT

CTCCTGCAGGGCCAGACAGAGCATTGGCACAGCCATACACTGGTATCAGCAAAGAACAAAT

GGTTCTCCAAGGCTTCTCATAAAGTATGCTTCTGAGTCTATCTCTGGGATCCCTTCCAGGTTT

AGCGGCAGTGGATCAGGGACAGATTTTACTCTTACCATCAACAGTGTGGAGTCTGAAGATAT

TGCAGATTATTACTGTCAACAAAGTGGGAGCTGGCCGTACACGTTcGGAGGGGGGACCAAG

CTGGAAATAAAAGGCGGATCTGAGGGAAAGTCCAGCGGCTCCGGCAGCGAAAGCAAGTCCA

CCGGCGGAAGCGAGGTGCAACTGGTGGAGTCTGGGGGAGGCCTGGTCAAGCCTGGGGGGTC

CCTGAGACTCTCCTGTGCAGCCTCTGGATTCACCTTCAGTAGATATAACATGAACTGGGTCC

GCCAGGCTCCAGGGAAGGGGCTGGAGTGGGTCTCATCCATTAGTACTAGTAGTAATTACATA

TACTACGCAGACTCAGTGAAGGGCCGATTCACCTTCTCCAGAGACAACGCCAAGAACTCACT

GGATCTGCAAATGAGCGGCCTGAGAGCCGAGGACACGGCTATTTATTACTGTACGAGAGGC

```
TGGGGGCCTTTTGACTACTGGGGCCAGGGAACCCTGGTCACCGTCTCCTCAGAGCCCAAATC

TAGCGACAAAACTCACACATGTCCACCGTGCCCAGCACCTGAAGCAGCAGGGGGACCGTCA

GTCTTCCTCTTCCCCCCAAAACCCAAGGACACCCTCATGATCTCCCGGACCCCTGAGGTCAC

ATGCGTGGTGGTGAGCGTGAGCCACGAAGACCCTGAGGTCAAGTTCAACTGGTACGTGGAC

GGCGTGGAGGTGCATAATGCCAAGACAAAGCCGCGGGAGGAGCAGTACAACAGCACGTAC

CGTGTGGTCAGCGTCCTCACCGTCCTGCACCAGGACTGGCTGAATGGCAAGGAGTACAAGTG

CAAGGTCTCCAACAAAGCCCTCCCAGCCCCCATCGAGAAAACCATCTCCAAAGCCAAGGG

CAGCCCCGAGAACCACAGGTGTACGTGTACCCCCCATCCCGGGAGGAGATGACCAAGAACC

AGGTCAGCCTGACCTGCCTGGTCAAAGGCTTCTATCCCAGCGACATCGCCGTGGAGTGGGAG

AGCAATGGGCAGCCGGAGAACAACTACAAGACCACGCCTCCCGTGCTGGACTCCGACGGCT

CCTTCGCCCTCGTGAGCAAGCTCACCGTGGACAAGTCTAGATGGCAGCAGGGGAACGTCTTC

TCATGCTCCGTGATGCATGAGGCTCTGCACAACCACTACACGCAGAAGAGCCTCTCCCTGTC

TCCGGGTAAA
```

Engineering of CD3 Fabs for hK2/CD3 Bispecific Generation

The CD3 specific VH and VL regions were engineered in VH-CH1-hinge-CH2-CH3 and VL-CL formats respectively and expressed as IgG1. The polypeptide of SEQ ID NO: 158 comprising the Fc silencing mutation L234A/L235A/D265S and the CH3 mutation T350V/L351Y/F405A/Y407V designed to promote selective heterodimerization was used to generate the CD3 specific VH-CH-hinge-CH2-CH3 (Table 29).

```
(huIgG1_G1m(17)_AAS_ZWA)
                                          SEQ ID NO: 158
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPEAAGGPSVFLFPPKPKDTLMISRTPEVTCVVVSVS

HEDPEVKFNWYVDGVEVHNAKTKPREEQYNSTYRVVSVLTVLHQDWLNGK

EYKCKVSNKALPAPIEKTISKAKGQPREPQNTYVYYPSREEMTKNQVSLT

CLVKGFYPSDIAVEWESNGQPENNYKTTPPVLDSDGSFALVSKLTVDKSR

WQQGNVFSCSVMHEALHNHYTQKSLSLSPGK
```

The polypeptides of SEQ ID NO: 309 or 447 were used to generate the CD3 specific VL-CL (Table 30)

```
(human kappa light chain)
                                          SEQ ID NO: 309
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC (human lambda light chain)
                                          SEQ ID NO: 447
GQPKAAPSVTLFPPSSEELQANKATLVCLISDFYPGAVTVAWKADSSPVK

AGVETTTPSKQSNNKYAASSYLSLIPEQWKSHRSYSCQVTHEGSTVEKTV

APTECS
```

SEQ ID NO: of DNA sequences of anti-CD3 molecules in VH-CH-hinge-CH2-CH3 and Vl-CL format are shown in Table 31.

TABLE 29

| VH-CH1-hinge-CH2-CH3. heavy chain amino acid sequences of selected anti CD3 antibodies | | |
|---|---|---|
| HC protein | SEQ ID NO: | HC amino acid sequence |
| CD3W244 HC, CD3W245 HC, CD3W246 HC, CD3W247 HC, CD3W248 HC, | 264 | EVQLVESGGGLVKPGGSLRLSCAASGFTFSRYNMNWVRQAPGKGL EWVSSISTSSNYIYYADSVKGRFTFSRDNAKNSLDLQMSGLRAEDT AIYYCTRGWGPFDYWGQGTLVTVSSASTKGPSVFPLAPSSKSTSGG TAALGCLVKDYFPEPVTVSWNSGALTSGVHTFPAVLQSSGLYSLSS VVTVPSSSLGTQTYICNVNHKPSNTKVDKKVEPKSCDKTHTCPPCP APEAAGGPSVFLFPPKPKDTLMISRTPEVTCVVVSVSHEDPEVKFNW YVDGVEVHNAKTKPREEQYNSTYRVVSVLTVLHQDWLNGKEYKC KVSNKALPAPIEKTISKAKGQPREPQVYVYPPSREEMTKNQVSLTCL VKGFYPSDIAVEWESNGQPENNYKTTPPVLDSDGSFALVSKLTVDK SRWQQGNVFSCSVMHEALHNHYTQKSLSLSPGK |
| CD3B376 HC | 359 | QVQLQQSGPRLVRPSQTLSLTCAISGDSVFNNNAAWSWIRQSPSRG LEWLGRTYYRSKWLYDYAVSVKSRITVNPDTSRNQFTLQLNSVTPE DTALYYCARGYSSSFDYWGQGTLVTVSSASTKGPSVFPLAPSSKSTS GGTAALGCLVKDYFPEPVTVSWNSGALTSGVHTFPAVLQSSGLYSL |

TABLE 29-continued

VH-CH1-hinge-CH2-CH3. heavy chain amino acid sequences
of selected anti CD3 antibodies

| HC protein | SEQ ID NO: | HC amino acid sequence |
|---|---|---|
| | | SSVVTVPSSSLGTQTYICNVNHKPSNTKVDKKVEPKSCDKTHTCPPC PAPEAAGGPSVFLFPPKPKDTLMISRTPEVTCVVVSVSHEDPEVKFN WYVDGVEVHNAKTKPREEQYNSTYRVVSVLTVLHQDWLNGKEYK CKVSNKALPAPIEKTISKAKGQPREPQVYVYPPSREEMTKNQVSLTC LVKGFYPSDIAVEWESNGQPENNYKTTPPVLDSDGSFALVSKLTVD KSRWQQGNVFSCSVMHEALHNHYTQKSLSLSPG |

TABLE 30

VL-CL light chain amino acid sequences of selected anti-CD3 antibodies

| HC protein | SEQ ID NO: | LC amino acid sequence |
|---|---|---|
| CD3W244 LC | 266 | DIQMTQSPSSLSASVGDRVTITCRARQSIGTAIHWYQQKPGKAPKLL IYYASESISGVPSRFSGSGSGTDFTLTISSVQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W245 LC | 267 | DIQMTQSPSSLSASVGDRVTITCRARQSIGTAIHWYQQKPGKAPKLL IKYASESISGVPSRFSGSGSGTDFTLTISSLQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W246 LC | 268 | DIQMTQSPSSLSASVGDRVTITCRARQSIGTAIHWYQQKPGKAPKLL IKYASESISGVPSRFSGSGSGTDFTLTISSVQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W247 LC | 269 | DIQMTQSPSSLSASVGDRVTITCRARQSIGTAIHWYQQKPGKAPKLL IYYASESISGVPSRFSGSGSGTDFTLTISSLQPEDFATYYCQQSGSWP YTFGQGTKLEIKRTVAAPSVFIFPPSDEQLKSGTASVVCLLNNFYPRE AKVQWKVDNALQSGNSQESVTEQDSKDSTYSLSSTLTLSKADYEK HKVYACEVTHQGLSSPVTKSFNRGEC |
| CD3W248 LC | 270 | DILLTQSPGILSVSPGERVSFSCRARQSIGTAIHWYQQRTNGSPRLLIK YASESISGIPSRFSGSGSGTDFTLTINSVESEDIADYYCQQSGSWPYTF GGGTKLEIKRTVAAPSVFIFPPSDEQLKSGTASVVCLLNNFYPREAK VQWKVDNALQSGNSQESVTEQDSKDSTYSLSSTLTLSKADYEKHK VYACEVTHQGLSSPVTKSFNRGEC |
| CD3B376 LC | 272 | QSALTQPASVSGSPGQSITISCTGTSSNIGTYKFVSWYQQHPDKAPK VLLYEVSKRPSGVSSRFSGSKSGNTASLTISGLQAEDQADYHCVSYA GSGTLLFGGGTKLTVLGQPKAAPSVTLFPPSSEELQANKATLVCLIS DFYPGAVTVAWKADSSPVKAGVETTTPSKQSNNKYAASSYLSLTPE QWKSHRSYSCQVTHEGSTVEKTVAPTECS |

TABLE 31 cDNA SEQ ID NOs of anti-CD3 antibodies HC in VH-CH1-
hinge-CH2-CH3 (HC) format and LC in VL-CL (LC) format

| Antibody | HC cDNA SEQ ID NO: | LC cDNA SEQ ID NO: |
|---|---|---|
| CD3W244 | 471 | 311 |
| CD3W245 | 471 | 452 |
| CD3W246 | 471 | 313 |
| CD3W247 | 471 | 314 |
| CD3W248 | 471 | 315 |
| CD3B376 | 471 | 317 |

(CD3W244, CDRW245, CD3W246, CD3W247, CD3W248 HC cDNA)
SEQ ID NO: 471
GAGGTGCAGCTGGTGGAGAGCGGTGGCGGTCTGGTGAAGCCAGGTGGCAGCCTGCGCCTGA

GCTGTGCCGCCAGCGGTTTCACCTTCAGCCGCTACAACATGAACTGGGTGCGCCAAGCCCCA

GGCAAGGGCCTGGAGTGGGTGAGCAGCATCAGCACCAGCAGCAACTACATCTACTACGCCG

ACAGCGTGAAGGGCCGCTTCACCTTCAGCCGCGACAACGCCAAGAACAGCCTGGACCTGCA

GATGAGCGGTCTGCGCGCCGAGGACACCGCCATCTACTACTGCACCCGCGGTTGGGGCCCAT

TCGACTACTGGGGCCAGGGCACCCTGGTGACCGTGAGCAGCGCCTCCACCAAGGGCCCATC

GGTCTTCCCCCTGGCACCCTCCTCCAAGAGCACCTCTGGGGGCACAGCGGCCCTGGGCTGCC

TGGTCAAGGACTACTTCCCCGAACCGGTGACGGTGTCGTGGAACTCAGGCGCCCTGACCAGC

GGCGTGCACACCTTCCCGGCTGTCCTACAGTCCTCAGGACTCTACTCCCTCAGCAGCGTGGT

GACCGTGCCCTCCAGCAGCTTGGGCACCCAGACCTACATCTGCAACGTGAATCACAAGCCCA

GCAACACCAAGGTGGACAAGAAAGTTGAGCCCAAATCTTGTGACAAAACTCACACATGTCC

ACCGTGCCCAGCACCTGAAGCAGCAGGGGGACCGTCAGTCTTCCTCTTCCCCCCAAAACCCA

AGGACACCCTCATGATCTCCCGGACCCCTGAGGTCACATGCGTGGTGGTGAGCGTGAGCCAC

GAAGACCCTGAGGTCAAGTTCAACTGGTACGTGGACGGCGTGGAGGTGCATAATGCCAAGA

CAAAGCCGCGGGAGGAGCAGTACAACAGCACGTACCGTGTGGTCAGCGTCCTCACCGTCCT

GCACCAGGACTGGCTGAATGGCAAGGAGTACAAGTGCAAGGTCTCCAACAAAGCCCTCCCA

GCCCCCATCGAGAAAACCATCTCCAAAGCCAAAGGGCAGCCCCGAGAACCACAGGTGTACG

TGTACCCCCCATCCCGGGAGGAGATGACCAAGAACCAGGTCAGCCTGACCTGCCTGGTCAA

AGGCTTCTATCCCAGCGACATCGCCGTGGAGTGGGAGAGCAATGGGCAGCCGGAGAACAAC

TACAAGACCACGCCTCCCGTGCTGGACTCCGACGGCTCCTTCGCCCTCGTGAGCAAGCTCAC

CGTGGACAAGTCTAGATGGCAGCAGGGGAACGTCTTCTCATGCTCCGTGATGCATGAGGCTC

TGCACAACCACTACACGCAGAAGAGCCTCTCCCTGTCTCCGGGTAAA (CD3W244 LC cDNA)
SEQ ID NO: 311
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT (CD3W245 LC cDNA)
SEQ ID NO: 452
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

-continued

```
AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT
```

(CD3W246 LC cDNA)
SEQ ID NO: 313
```
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCAAGTACGCCAGCGAGAGCATCAGCGGTGTGCCAAGCCGCT

TCAGCGGCAGCGGCAGCGGCACCGACTTCACCCTGACCATCAGCAGCGTGCAGCCAGAGGA

CTTCGCCACCTACTACTGCCAGCAGAGCGGCAGCTGGCCATACACCTTCGGCCAGGGCACCA

AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT
```

(CD3W247 LC cDNA)
SEQ ID NO: 314
```
GACATCCAGATGACCCAGAGCCCAAGCAGCCTGAGCGCCAGCGTCGGCGACCGCGTGACCA

TCACCTGTCGTGCCCGCCAGAGCATCGGCACCGCCATCCACTGGTACCAGCAGAAGCCAGGC

AAGGCCCCAAAGCTGCTGATCTACTACGCCAGCGAGAGCATCAGCGGTGTGCCAAGCCGCT

TCAGCGGCAGCGGCAGCGGCACCGACTTCACCCTGACCATCAGCAGCCTGCAGCCAGAGGA

CTTCGCCACCTACTACTGCCAGCAGAGCGGCAGCTGGCCATACACCTTCGGCCAGGGCACCA

AGCTGGAGATCAAGCGTACGGTGGCTGCACCATCTGTCTTCATCTTCCCGCCATCTGATGAG

CAGTTGAAATCTGGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGGAGAGTGTCACA

GAGCAGGACAGCAAGGACAGCACCTACAGCCTCAGCAGCACCCTGACGCTGAGCAAAGCAG

ACTACGAGAAACACAAAGTCTACGCCTGCGAAGTCACCCATCAGGGCCTGAGCTCGCCCGT

CACAAAGAGCTTCAACAGGGGAGAGTGT
```

(CD3W248 LC cDNA)
SEQ ID NO: 315
```
GACATCTTGCTGACTCAGTCTCCAGGCATCCTGTCTGTGAGTCCAGGAGAAAGAGTCAGTTT

CTCCTGCAGGGCCAGACAGAGCATTGGCACAGCCATACACTGGTATCAGCAAAGAACAAAT

GGTTCTCCAAGGCTTCTCATAAAGTATGCTTCTGAGTCTATCTCTGGGATCCCTTCCAGGTTT

AGCGGCAGTGGATCAGGGACAGATTTTACTCTTACCATCAACAGTGTGGAGTCTGAAGATAT

TGCAGATTATTACTGTCAACAAAGTGGGAGCTGGCCGTACACGTTCGGAGGGGGGACCAAG

CTGGAAATAAAACGTACGGTGGCTGCACCATCTGTCTTCATCTTCCCGCCATCTGATGAGCA

GTTGAAATCTGGAACTGCCTCTGTTGTGTGCCTGCTGAATAACTTCTATCCCAGAGAGGCCA

AAGTACAGTGGAAGGTGGATAACGCCCTCCAATCGGGTAACTCCCAGGAGAGTGTCACAGA

GCAGGACAGCAAGGACAGCACCTACAGCCTCAGCAGCACCCTGACGCTGAGCAAAGCAGAC
```

-continued

```
TACGAGAAACACAAAGTCTACGCCTGCGAAGTCACCCATCAGGGCCTGAGCTCGCCCGTCA

CAAAGAGCTTCAACAGGGGAGAGTGT
```

Engineering of hK2 scFvs-Fc for hK2/CD3 Bispecific Generation hK2 VH/VL regions engineered as scFvs in either VH-Linker-VL or VL-linker-VH orientations using the linker of SEQ ID NO: 7 (Table 1) as described in Example 2 were further engineered into a scFv-hinge-CH2-CH3 format comprising the Fc silencing mutation (L234A/L235A/D265S) and the T350V/T366L/K392L/T394W mutations designed to promote selective heterodimerization and expressed as IgG1. The polypeptide of SEQ ID NO: 110 was used as the constant domain hinge-CH2-CH3.

(huIgG1_G1M(17)-hinge-Fc_C220S_AAS_ZWB)
SEQ ID NO: 110
EPKSSDKTHTCPPCPAPEAAGGPSVFLFPPKPKDTLMISRTPEVICVVVS
VSHEDPEVKFNWYVDGVEVHNAKTKPREEQYNSTYRVVSVLTVLHQDWLN
GKEYKCKVSNKALPAPIEKTISKAKGQPREPQVYVLPPSREEMTKNQVSL
LCLVKGFYPSDIAVEWESNGQPENNYLTWPPVLDSDGSFFLYSKLTVDKS
RWQQGNVFSCSVMHEALHNHYTQKSLSLSPG Amino acid sequences of anti-hK2 molecules in scFv-hinge-CH2-CH3 format (scFv-Fc) are shown in Table 32.

TABLE 32

Amino acid sequences of anti-hK2 molecules in scFvs-Fc format used for hK2/CD3 bispecific generation

| Protein | SEQ ID NO | Amino acid sequence |
|---|---|---|
| KL2B359-LH-scFv-Fc | 351 | EIVLTQSPATLSLSPGERATLSCRASESVEYFGTSLMHWY QQKPGQPPRLLIYAASNVESGIPARFSGSGSGTDFTLTISSV EPEDFAVYFCQQTRKVPYTFGGGTKVEIKGGSEGKSSGSG SESKSTGGSQVQLQESGPGLVKPSQTLSLTCTVSGNSITSD YAWNWIRQFPGKRLEWIGYISYSGSTTYNPSLKSRVTISR DTSKNQFSLKLSSVTAADTAVYYCATGYYYGSGFWGQG TLVTVSSEPKSSDKTHTCPPCPAPEAAGGPSVFLFPPKPKD TLMISRTPEVTCVVVSVSHEDPEVKFNWYVDGVEVHNAK TKPREEQYNSTYRVVSVLTVLHQDWLNGKEYKCKVSNK ALPAPIEKTISKAKGQPREPQVYVLPPSREEMTKNQVSLLC LVKGFYPSDIAVEWESNGQPENNYLTWPPVLDSDGSFFLY SKLTVDKSRWQQGNVFSCSVMHEALHNHYTQKSLSLSPG |
| KL2B413-LH-scFv-Fc | 352 | EIVLTQSPSFLSASVGDRVTITCRASQGISSYLSWYQQKPG KAPKLLIYATSTLQSGVPSRFSGSGSGTEFTLTISSLQPEDF ATYYCQQLNSYPRTFGQGTKVEIKGGSEGKSSGSGSESKS TGGSEVQLVESGGGLNQPGGSLRLSCAASGFTFSSYWMT WVRQAPGKGLEWVANIKQDGSERYYVDSVKGRFTISRD NAKNSLYLQMNSLRAEDTAVYYCARDQNYDILTGHYGM DVWGQGTTVTVSSEPKSSDKTHTCPPCPAPEAAGGPSVFL FPPKPKDTLMISRTPEVTCVVVSVSHEDPEVKFNWYVDG VEVHNAKTKPREEQYNSTYRVVSVLTVLHQDWLNGKEY KCKVSNKALPAPIEKTISKAKGQPREPQVYVLPPSREEMT KNQVSLLCLVKGFYPSDIAVEWESNGQPENNYLTWPPVL DSDGSFFLYSKLTVDKSRWQQGNVFSCSVMHEALHNHY TQKSLSLSPG |
| KL2B467-LH-scFv-Fc | 353 | QSVLTQPPSVSVAPGQTASITCGGDNIGSKSVHWYQQKPG QAPVLVVYDNSDRPSGIPERFSGSNSGTTATLTISRVEAGD EADYYCQVWDSSSDHPVVFGGGTKVTVLGGSEGKSSGS GSESKSTGGSQVQLVESGGGVVQPGRSIALSCAASGFTFS YYGMHWVRQAPGKGLEWVAFISYDGSNKYYADSVKGR FTISRDNSKNTLYLQMNSLRAEDTAVYYCAHLPYSGSYW AFDYWGQGTQVTVSSEPKSSDKTHTCPPCPAPEAAGGPS VFLFPPKPKDTLMISRTPEVTCVVVSVSHEDPEVKFNWYV DGVEVHNAKTKPREEQYNSTYRVVSVLTVLHQDWLNGK EYKCKVSNKALPAPIEKTISKAKGQPREPQVYNLPPSREE MTKNQVSLLCLNKGFYPSDIAVEWESNGQPENNYLTWPP VLDSDGSFFLYSKLTVDKSRWQQGNVFSCSVMHEALHN HYTQKSLSLSPG |
| KL2B494-LH-scFv-Fc | 357 | SSELTQPPSVSVAPGQTARITCGGNNIGSKSVHWYQQKPG QAPVLVVYDDSDRPSGIPERFSGSNSGNTATLTISRVEAGD EADYYCQVWDSSSDHVVFGGGTKLTVLGGSEGKSSGSGS ESKSTGGSQVQLVESGGGLVQPGGSLRLSCAASGFTFSHY AMSWVRQAPGKGLEWVSTIGGSGGSTYYADSVKGRFTIS RDNSKNTLYLQMNSLRAEDTAVYYCAKPHIVMVTALLY DGMDVWGQGTMVTVSSEPKSSDKTHTCPPCPAPEAAGG PSVFLFPPKPKDTLMISRTPEVTCVVVSVSHEDPEVKFNW YVDGVEVHNAKTKPREEQYNSTYRVVSVLTVLHQDWLN |

TABLE 32-continued

Amino acid sequences of anti-hK2 molecules in scFvs-Fc format used for hK2/CD3 bispecific generation

| Protein | SEQ ID NO:Amino acid sequence |
|---|---|
| | GKEYKCKVSNKALPAPIEKTISKAKGQPREPQVYVLPPSR<br>EEMTKNQVSLLCLVKGFYPSDIAVEWESNGQPENNYLTW<br>PPVLDSDGSFFLYSKLTVDKSRWQQGNVFSCSVMHEALH<br>NHYTQKSLSLSPG |

Engineering of hK2 Fab-Fc for hK2/CD3 Bispecific Generation

The hK2 specific VH and VL regions were engineered in VH-CH1-hinge-CH2-CH3 and VL-CL formats respectively. The polypeptide of SEQ ID NO: 378 comprising the Fc silencing mutation L234A/L235A/D265S and the CH3 mutation T350V/T366U/K392L/T394W designed to promote selective heterodimerization was used to generate the KLK2 specific VH-CH1-hinge-CH2-CH3).

(huIgG1_G1m(17)_AAS_ZWB)
SEQ ID NO: 378
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPEAAGGPSVFLFPPKPKDTLMISRTPEVTCVVVSVS

HEDPEVKFNWYVDGVEVHNAKTKPREEQYNSTYRVVSVLTVLHQDWLNGK

EYKCKVSNKALPAPIEKTISKAKGQPREPQVYVLPPSREEMTKNQVSLLC

-continued
LVKGFYPSDIAVEWESNGQPENNYLTWPPVLDSDGSFFLYSKLTVDKSRW

QQGNVFSCSVMHEALHNHYTQKSLSLSPGK

The polypeptides of SEQ ID NO: 309 or 447 were used to generate the hK2 specific VL-CL.

(human kappa light chain)
SEQ ID NO: 309
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPVT

KSFNRGEC (human lambda light chain)
SEQ ID NO: 447
GQPKAAPSVTLFPPSSEELQANKATLVCLISDFYPGAVTVAWKADSSPVK

AGVETTTPSKQSNNKYAASSYLSLTPEQWKSHRSYSCQVTHEGSTVEKTV

APTECS

The amino acid sequences of hK2 Fab-Fc HC are show in Table 33.

TABLE 33

Amino acid sequences of hK2 Fab-Fc HC (VH-CH1-hinge-CH2-CH3) for hK2/CD3 bispecific generation

| Protein | SEQ ID NO: | Amino acid sequence |
|---|---|---|
| KL2B30 Fab HC | 354 | QVQLQESGPGINKPSETLSLTCTVSGGSISSYYWSWIRQPP<br>GKGLEWIGYIYYSGSTNYNPSLKSRVTISVDTSKNQFSLKL<br>SSVTAADTAVYYCAGTTIFGVVTPNFYYGNIDVWGQGTT<br>VTVSSASTKGPSVFPLAPSSKSTSGGTAALGCLVKDYFPEP<br>VTVSWNSGALTSGVHTFPAVLQSSGLYSLSSVVTVPSSSL<br>GTQTYICNVNHKPSNTKVDKKVEPKSCDKTHTCPPCPAPE<br>AAGGPSVFLFPPKPKDTLMISRTPEVTCVVVSVSHEDPEV<br>KFNWYVDGVEVHNAKTKPREEQYNSTYRVVSVLTVLHQ<br>DWLNGKEYKCKVSNKALPAPIEKTISKAKGQPREPQVYV<br>LPPSREEMTKNQVSLLCLVKGFYPSDIAVEWESNGQPENN<br>YLTWPPVLDSDGSFFLYSKLTVDKSRWQQGNVFSCSVMH<br>EALHNHYTQKSLSLSPG |
| KL2B242 Fab HC | 355 | QVQLQESGPGLVKPSETLSLTCTVSGGSISSYYWSWLRQP<br>AGSGLEWIGRLYVSGFTNYNPSLKSRVTLSLDPSRNQLSL<br>KLSSVTAADTAVYYCAGDSGNYWGWFDPWGQGTLVTV<br>SSASTKGPSVFPLAPSSKSTSGGTAALGCLVKDYFPEPVTV<br>SWNSGALTSGVHTFPAVLQSSGLYSLSSVVTVPSSSLGTQ<br>TYICNVNHKPSNTKVDKKVEPKSCDKTHTCPPCPAPEAA<br>GGPSVFLFPPKPKDTLMISRTPEVTCVVVSVSHEDPEVKFN<br>WYNDGVEVHNAKTKPREEQYNSTYRVVSVLTVLHQDW<br>LNGKEYKCKVSNKALPAPIEKTISKAKGQPREPQVYVLPP<br>SREEMTKNQVSLLCLNKGFYPSDIAVEWESNGQPENNYL<br>TWPPVLDSDGSFFLYSKLTVDKSRWQQGNVFSCSVMHEA<br>LHNHYTQKSLSLSPG |
| KL2B53 Fab HC | 356 | EVQLVESGGGVVQPGRSLRLSCVASGFTFSSYDIHWVRQ<br>APGKGLEWVAIISYDGSKKDYTSVKGRFTISRDNSKNTL<br>YLQMDSLRVEDSAVYSCARESGWSHYYYGMDVWGQG<br>TMVTVSSASTKGPSVFPLAPSSKSTSGGTAALGCLVKDYF<br>PEPVTVSWNSGALTSGVHTFPAVLQSSGLYSLSSVVTVPS |

TABLE 33-continued

Amino acid sequences of hK2 Fab-Fc HC (VH-CH1-hinge-CH2-CH3)
for hK2/CD3 bispecific generation

| Protein | SEQ ID NO: | Amino acid sequence |
|---|---|---|
| | | SSLGTQTYICNVNHKPSNTKVDKKVEPKSCDKTHTCPPCP APEAAGGPSVFLFPPKPKDTLMISRTPEVTCVVVSVSHEDP EVKFNWYVDGVEVHNAKTKPREEQYNSTYRVVSVLTVL HQWLNGKEYKCKVSNKALPAPIEKTISKAKGQPREPQV YVLPPSREEMTKNQVSLLCLVKGFYPSDIAVEWESNGQPE NNYLTWPPVLDSDGSFFLYSKLINDKSRWQQGNNFSCSV MHEALHNHYTQKSLSLSPG |
| KL2B30 Fab w/K477 | 361 | QVQLQESGPGLVKPSETLSLTCTVSGGSISSYYWSWIRQPP GKGLEWIGYIYYSGSTNYNPSLKSRVTISVDTSKNQFSLKL SSVTAADTAVYYCAGTTIFGVVTPNFYYGMDVWGQGTT VTVSSASTKGPSVFPLAPSSKSTSGGTAALGCLVKDYFPEP VTVSWNSGALTSGVHTFPAVLQSSGLYSLSSVVTVPSSSL GTQTYICNHKPSNTKVDKKVEPKSCDKTHTCPPCPAPE AAGGPSVFLFPPKPKDTLMISRTPEVTCVVVSVSHEDPEV KFNWYVDGVEVHNAKTKPREEQYNSTYRVVSVLTVLHQ DWLNGKEYKCKVSNKALPAPIEKTISKAKGQPREPQVYV LPPSREEMTKNQVSLLCLVKGFYPSDIAVEWESNGQPENN YLTWPPVLDSDGSFFLYSKLTVDKSRWQQGNVESCSVMH EALHNHYTQKSLSLSPGK | hK2/CD3 Bispecifics

CD3B376 and CD3W245, engineered as Fabs and the hK2 VH/VL regions of KL2B359, KL2B413, KL2B467 and KL2B494 engineered as scFvs in both orientation as described above, were expressed to generate bispecific antibodies, yielding hK2/CD3 bispecific antibodies with a hK2 binding arm in a format scFv-hinge-CH2-CH3 and a CD3 binding arm in a format of: heavy chain: VH-CH1-hinge-CH2-CH3 and light chain: VL-CL. Alternatively, the VH/VL regions of the anti-CD3 antibodies CD3W245 engineered as scFvs in the LH-linker-VH orientation and the VH/VL regions of the anti-hK2 antibodies KL2B30, KL2B242 and KL2B53 engineered as Fabs as described above, were expressed to generate bispecific antibodies, yielding hK2/CD3 bispecific antibodies with a hK2 binding arm in the format of a heavy chain VH-CH1-hinge-CH2-CH3 and light chain VL-CL and a CD3 binding arm in a format scFv-hinge-CH2-CH3. The linker used to generate the anti-scFv is the linker of SEQ ID NO: 7.

T350V_L351Y_F405A_Y407V CH3 mutations were engineered into one heavy chain and T350V_T366L_K392L_T394W CH3 mutations were engineered into the other heavy chain as described above. In addition, both HK2 and CD3 binding arms were engineered to contain Fc effector silencing mutations L234A_L235A_D265S as described above.

The KL2B242 light chain, which belonged to the human lamda-3 germline, contained one free Cys residue which was mutated into a Ser (C33S) to eliminate the unpaired free Cys and prevent potential manufacturability issues.

The engineered chains were expressed, and the resulting bispecific antibodies purified using standard methods. The bispecific antibodies were characterized for their binding to hK2 and CD3, and their in vitro and in vivo cytotoxicity as described in Example 8 and 9. Table 34 shows the CDR SEQ ID NOs: of selected anti hKL2/CD3 bispecific antibodies. Table 35 shows the VH, VL and scFv SEQ ID NOs: of selected anti hKL2/CD3 bispecific antibodies. Table 36 shows the HC1, HC2, LC1 and LC2 SEQ ID NOs of selected anti hKL2/CD3 bispecific antibodies. HC1 and LC1 refer to the heavy and light chain of the hKL2 binding arm. Alternatively, HC1 can also refer to the scFv-hinge-CH2-CH3 of the hKl2 binding arm. HC2 and LC2 refer to the heavy and light chain of the CD3 binding arm. Alternatively, HC2 can also refer to the scFv-hinge-CH2-CH3 of the CD3 binding arm. Table 37 the amino acid sequences of HC1, LC1, HC2 and LC2. Table 37 the cDNA sequences of HC1, LC1, HC2 and LC2.

TABLE 34

Kabat CDR SEQ ID NOs of bispecific hK2/CD3 antibodies

| Bispecific antibody | Parental (hK2 arm/CD3 arm) | HCDR1 | HCDR2 | HCDR3 | LCDR1 | LCDR2 | LCDR3 |
|---|---|---|---|---|---|---|---|
| KLCB91 | KL2B359-LH-scFv | 63 | 65 | 66 | 67 | 69 | 71 |
| | CD3W245 Fab | 255 | 256 | 257 | 258 | 259 | 261 |
| KLCB105 | KL2B359-LH-scFv | 63 | 65 | 66 | 67 | 69 | 71 |
| | CD3B376 Fab | 116 | 117 | 118 | 119 | 120 | 121 |
| KLCB95 | KL2B413-LHscFv | 141 | 142 | 143 | 144 | 145 | 146 |
| | CD3W245 Fab | 255 | 256 | 257 | 258 | 259 | 261 |
| KLCB96 | KL2B413-LH-scFv | 141 | 142 | 143 | 144 | 145 | 146 |
| | CD3B376 Fab | 116 | 117 | 118 | 119 | 120 | 121 |
| KLCB170 | KL2B467-LH-scFv | 188 | 189 | 190 | 191 | 192 | 193 |
| | CD3W245 Fab | 255 | 256 | 257 | 258 | 259 | 261 |
| KLCB80 | KL2B30 Fab | 170 | 171 | 172 | 173 | 174 | 175 |
| | CD3W245-LH-scFv | 255 | 256 | 257 | 258 | 259 | 261 |

TABLE 34-continued

Kabat CDR SEQ ID NOs of bispecific hK2/CD3 antibodies

| Bispecific antibody | Parental (hK2 arm/CD3 arm) | HCDR1 | HCDR2 | HCDR3 | LCDR1 | LCDR2 | LCDR3 |
|---|---|---|---|---|---|---|---|
| KLCB81 | KL2B242 LC_C33S Fab | 170 | 183 | 184 | 185 | 186 | 187 |
| | CD3W245-LH-scFv | 255 | 256 | 257 | 258 | 259 | 261 |
| KLCB113 | KL2B53 Fab | 176 | 177 | 178 | 179 | 180 | 181 |
| | CD3W245-LH-scFv | 255 | 256 | 257 | 258 | 259 | 261 |
| KLCB281 | KL2B467-LH-scFv | 188 | 189 | 190 | 191 | 192 | 193 |
| | CD3B376-Fab | 116 | 117 | 118 | 119 | 120 | 121 |
| KLCB174 | KL2B494-LH-scFv | 206 | 207 | 208 | 182 | 470 | 209 |
| | CD3B376-Fab | 116 | 117 | 118 | 119 | 120 | 121 |
| KLCB153 | KL2B494-LH-scFv | 206 | 207 | 208 | 182 | 470 | 209 |
| | CD3W245-Fab | 255 | 256 | 257 | 258 | 259 | 261 |
| KLCB245 | KL2B30-Fab w/K447 | 170 | 171 | 172 | 173 | 174 | 175 |
| | CD3W245-LH-scFv w/K447 | 255 | 256 | 257 | 258 | 259 | 261 |

TABLE 35

SEQ ID NOs of the variable region of the hK2 arm and the CD3 arm of selected KL2/CD3 bispecific antibodies.

| | hK2 arm | | | | CD3 arm | | | |
|---|---|---|---|---|---|---|---|---|
| Bispecific Name | Name | VH1 SEQ ID NO: | VL1 SEQ ID NO: | scFv SEQ ID NO | Name | VH2 SEQ ID NO: | VL2 SEQ ID NO: | scFv SEQ ID NO: |
| KLCB91 | KL2B359-LH-scFv(scFv20) | | | 136 | CD3W245 Fab | 248 | 251 | |
| KLCB105 | KL2B359-LHscFv (scFv20) | | | 136 | CD3B376 Fab | 122 | 123 | |
| KLCB95 | KL2B413-LH-scFv (scFv18) | | | 134 | CD3W245 Fab | 248 | 251 | |
| KLCB96 | KL2B413-LH-scFv(scFv18) | | | 134 | CD3B376 Fab | 122 | 123 | |
| KLCB170 | KL2B467-LH-scFv(scFv28) | | | 325 | CD3W245 Fab | 248 | 251 | |
| KLCB80 | KL2B30 Fab | 162 | 163 | | CD3W245-LH-scFv (scFv32) | | | 331 |
| KLCB81 | KL2B242LC_C33S Fab | 166 | 444 | | CD3W245-LH-scFv (scFv32) | | | 331 |
| KLCB113 | KL2B53 Fab | 164 | 165 | | CD3W245-LH-scFv (scFv32) | | | 331 |
| KLCB281 | KL2B467-LH-scFv (scFv28) | | | 325 | CD3B376 Fab | 122 | 123 | |
| KLCB174 | KL2B494-LH-scFv | | | 316 | CD3B376-Fab | 122 | 123 | |
| KLCB153 | KL2B494-LH-scFv | | | 316 | CD3W245-Fab | 248 | 251 | |
| KLCB245 | KL2B30-Fab w/ K447 | 162 | 163 | | CD3W245-LH-scFv w/K447 | | | 331 |

TABLE 36

HC and LC amino acid SEQ ID NOs of hK2/CD3 bispecific antibodies

| | hK2 arm | | | CD3 arm | | |
|---|---|---|---|---|---|---|
| Bispecific Name | Name | HC1 or scFv -Fc SEQ ID NO: | LC1 SEQ ID NO: | Name | HC2 or scFv - Fc SEQ ID NO: | LC2 SEQ ID NO: |
| KLCB91 | KL2B359 LH-Fc | 351 | | CD3W245 Fab | 358 | 267 |
| KLCB105 | KL2B359-LH-Fc | 351 | | CD3B376 Fab | 359 | 272 |
| KLCB95 | KL2B413-LH-Fc | 352 | | CD3W245 Fab | 358 | 267 |
| KLCB96 | KL2B413-LH-Fc | 352 | | CD3B376 Fab | 359 | 272 |

TABLE 36-continued

HC and LC amino acid SEQ ID NOs of hK2/CD3 bispecific antibodies

| Bispecific Name | hK2 arm | | | CD3 arm | | |
|---|---|---|---|---|---|---|
| | Name | HC1 or scFv-Fc SEQ ID NO: | LC1 SEQ ID NO: | Name | HC2 or scFv-Fc SEQ ID NO: | LC2 SEQ ID NO: |
| KLCB170 | KL2B467-LH-Fc | 353 | | CD3W245 Fab | 358 | 267 |
| KLCB80 | KL2B30 Fab | 354 | 221 | CD3W245-LH-scFv-Fc | 360 | |
| KLCB81 | KL2B242LC_C33S Fab | 355 | 445 | CD3W245-LH-scFv-Fc | 360 | |
| KLCB113 | KL2B53 Fab | 356 | 222 | CD3W245-LH-scFv-Fc | 360 | |
| KLCB281 | KL2B467-LH-scFv (scFv28) | 353 | | CD3B376 Fab | 359 | 272 |
| KLCB174 | KL2B494-LH-scFv | 357 | | CD3B376-Fab | 359 | 272 |
| KLCB153 | KL2B494-LH-scFv | 357 | | CD3W245-Fab | 358 | 267 |
| KLCB245 | KL2B30-Fab w/ K447 | 361 | 221 | CD3W245-LH-scFv w/K447 | 362 | |

TABLE 37

Bispecific HC1 and HC2 amino acid sequences

| Protein | SEQ ID NO: | Amino acid sequence |
|---|---|---|
| KL2B359-LH-scFv-Fc | 351 | EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKRLEWIGYISYSGSTTYNPSILKSRVTISRDTSKNQFSLKLSSVTAADTAVYYCATGYYYGSGFWGQGTLVTVSSEPKSSDKTHTCPPCPAPEAAGGPSVFEFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG |
| KL2B413-LH-scFv-Fc | 352 | EIVLTQSPSFLSASVGDRVTITCRASQGISSYLSWYQQKPGKAPKLLIYATSTLQSGVPSRFSGSGSGTEFTLTISSEQPEDFATYYCQQLNSYPRTFGQGTKVEIKGGSEGKSSGSGSESKSTGGSEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSEPKSSDKTHTCPPCPAPEAAGGPSVFLFPPKPKDTLMISRTPEVTCVVVSVSHEDPEVKFNWYVDGVENTHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSTFLYSKLTVDKSRWQQGNVFSCSVMHEALHNHYTQKSLSLSPG |
| KL2B467-LH-scFv-Fc | 353 | QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVLGGSEGKSSGSGSESKSTGGSQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSTFLYSKLIVDKSRWQQGNVFSCSVMHEALHNHYTQKSLSLSPG |
| KL2B30 Fab HC | 354 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEV |

TABLE 37-continued

Bispecific HC1 and HC2 amino acid sequences

| Protein | SEQ ID NO: | Amino acid sequence |
|---|---|---|
| | | KFNWYVDGVEVHNAKTKPREEQYNSTYRVVSVLTVLHQ<br>DWLNGKEYKCKVSNKALPAPIEKTISKAKGQPREPQVYV<br>LPPSREEMTKNQVSLLCLVKGFYPSDIAVEWESNGQPENN<br>YLTWPPVLDSDGSFFLYSKLTVDKSRWQQGNVFSCSVMH<br>EALHNHYTQKSLSLSPG |
| KL2B242 Fab HC | 355 | QVQLQESGPGLVKPSETLSLTCTVSGGSISSYYWSWLRQP<br>AGSGLEWIGRLYVSGFTNYNPSLKSRVTLSLDPSRNQLSL<br>KLSSVTAADTAVYYCAGDSGNYWGWFDPWGQGILVTV<br>SSASTKGPSVFPLAPSSKSTSGGTAALGCLVKDYFPEPVTV<br>SWNSGALTSGVHTFPAVLQSSGLYSLSSVVTVPSSSLGTQ<br>TYICNVNHKPSNTKVDKKVEPKSCDKTHTCPPCPAPEAA<br>GGPSVFLFPPKPKDTLMISRTPEVTCVVVSVSHEDPEVKFN<br>WYVDGVEVHNAKTKPREEQYNSTYRVVSVLTVLHQDW<br>LNGKEYKCKVSNKALPAPIEKTISKAKGQPREPQVYVLPP<br>SREEMTKNQVSLLCLVKGFYPSDIAVEWESNGQPENNYL<br>TWPPVLDSDGSFFLYSKLTVDKSRWQQGNVFSCSVMHEA<br>LHNHYTQKSLSLSPG |
| KL2B242LC_C33S_Fab<br>LC | 445 | SYELTQPPSVSVSPGETASITCSGDQLGENYASWYQQKPG<br>QSPVLVIYQDSKRPSGIPERFSGSNSGNTATLTISGTQALDE<br>ADYYCQAWDNSIVVITGGGTKLTVLGQPKAAPSVTLFPPS<br>SEELQANKATLVCLISDFYPGAVTVAWKADSSPVKAGVE<br>TTTPSKQSNNKYAASSYLSLTPEQWKSHRSYSCQVTHEGS<br>TVEKTVAPTECS |
| KL2B53 Fab HC | 356 | EVQLVESGGGVVQPGRSLRLSCVASGFTFSSYDIHWVRQ<br>APGKGLEWVAIISYDGSKKDYTDSVKGRFTISRDNSKNTL<br>YLQMDSLRVEDSAVYSCARESGWSHYYYYGMDVWGQG<br>TMVTVSSASTKGPSVFPLAPSSKSTSGGTAALGCLVKDYF<br>PEPVTVSWNSGALTSGVHTFPAVLQSSGLYSLSSVVTVPS<br>SSLGTQTYICNVNHKPSNTKVDKKVEPKSCDKTHTCPPCP<br>APEAAGGPSVFLFPPKPKDTLMISRTPEVTCVVVSVSHEDP<br>EVKFNWYVDGVEVHNAKTKPREEQYNSTYRVVSVLTVL<br>HQWLNGKEYKCKVSNKALPAPIEKTISKAKGQPREPQV<br>YVLPPSREEMTKNQVSLLCLNKGFYPSDIAVEWESNGQPE<br>NNYLTWPPVLDSDGSFFLYSKLIVDKSRWQQGNVFSCSV<br>MHEALHNHYTQKSLSLSPG |
| KL2B494-LH-<br>scFV-Fc | 357 | SSELTQPPSVSVAPGQTARITCGGNNIGSKSVHWYQQKPG<br>QAPVLVVYDDSDRPSGIPERFSGSNSGNTATLTISRVEAGD<br>EADYYCQVWDSSSDHVVFGGGTKLTVLGGSEGKSGSGS<br>ESKSTGGSQVQLVESGGGLVQPGGSLRLSCAASGFTFSHY<br>AMSWVRQAPGKGLEWVSTIGGSGGSTYYADSNIKGRFTIS<br>RDNSKNTLYLQMNSLRAEDTAVYYCAKPHIVMVTALLY<br>DGMDVWGQGTMVTVSSEPKSSDKTHTCPPCPAPEAAGG<br>PSVFLFPPKPKDTLMISRTPEVTCVVVSVSHEDPEVKFNW<br>YVDGVEVHNAKTKPREEQYNSTYRVVSVLTVLHQDWLN<br>GKEYKCKVSNKALPAPIEKTISKAKGQPREPQVYVLPPSR<br>EEMTKNQVSLICLVKGFYPSDIAVEWESNGQPENNYLTW<br>PPVLDSDGSFFLYSKLTVDKSRWQQGNVFSCSVMHEALH<br>NHYTQKSLSLSPG |
| KL2B30 Fab<br>w/K477 | 361 | QVQLQESGPGLVKPSETLSLTCTVSGGSISSYYWSWIRQPP<br>GKGLEWIGYIYYSGSTNYNPSLKSRVTISVDTSKNQFSLKL<br>SSVTAADTAVYYCAGTTIFGVVTPNFYYGMDVWGQGTT<br>VTVSSASTKGPSVFPLAPSSKSTSGGTAALGCLVKDYFPEP<br>VTVSWNSGALTSGVHTFPAVLQSSGLYSLSSVVTVPSSSL<br>GTQTYICNVNHKPSNTKVDKKVEPKSCDKTHTCPPCPAPE<br>AAGGPSVFLFPPKPKDTLMISRTPEVICVVVSVSHEDPEV<br>KFNWYVDGVEVHNAKTKPREEQYNSTYRVVSVLTVLHQ<br>DWLNGKEYKCKVSNKALPAPIEKTISKAKGQPREPQVYV<br>LPPSREEMTKNQVSLLCLVKGFYPSDIAVEWESNGQPENN<br>YLTNVPPVLDSDGSFFLYSKLTVDKSRWQQGNVFSCSVMH<br>EALHNHYTQKSLSLSPGK |
| CD3W245 Fab HC | 358 | EVQLVESGGGLVKPGGSLRLSCAASGFTFSRYNNINWVRQ<br>APGKGLEWVSSISTSSNYIYYADSVKGRFTFSRDNAKNSL<br>DLQMSGLRAEDTAIYYCTRGWGPFDYWGQGTLVTVSSA<br>STKGPSVFPLAPSSKSTSGGTAALGCLVKDYFPEPVTVSW<br>NSGALTSGVHTFPAVLQSSGLYSLSSVVTVPSSSLGTQTYI<br>CNVNHKPSNTKVDKKVEPKSCDKTHTCPPCPAPEAAGGP<br>SVTLFPPKPKDTLMISRTPEVTCVVVSVSHEDPEVKFNWY<br>VDGVEVHNAKTKPREEQYNSTYRVVSVLTVLHQDWLNG<br>KEYKCKVSNKALPAPIEKTISKAKGQPREPQVYVYPPSRE<br>EMTKNQVSLTCLVKGFYPSDIAVEWESNGQPENNYKTTP |

TABLE 37-continued

Bispecific HC1 and HC2 amino acid sequences

| Protein | SEQ ID NO: | Amino acid sequence |
|---|---|---|
| | | PVLDSDGSFALVSKLTVDKSRWQQGNVFSCSVMHEALH<br>NHYTQKSLSLSPG |
| CD3B376 Fab | 359 | QVQLQQSGPRLVRPSQTLSLTCAISGDSVFNNNAAWSIR<br>QSPSRGLEWLGRTYYRSKWLYDYAVSVKSRITVNPDTSR<br>NQFTLQLNSVTPEDTALYYCARGYSSSFDYWGQGTLVTV<br>SSASTKGPSVFPLAPSSKSTSGGTAALGCLVKDYFPEPVTV<br>SWNSGALTSGVHTFPAVLQSSGLYSLSSVVTVPSSSLGTQ<br>TYICNVNHKPSNTKVDKKVEPKSCDKTHTCPPCPAPEAA<br>GGPSVFLFPPKPKIYFLMISRTPEVTCVVVSVSHEDPEVKFN<br>WYVDGVEVHNAKTKPREEQYNSTYRVVSVLTVLHQDW<br>LNGKEYKCKVSNKALPAPIEKTISKAKGQPREPQVYVYPP<br>SREEMTKNQVSLTCLVKGFYPSDIAVEWESNGQPENNYK<br>TTPPVLDSDGSFALVSKLTVDKSRWQQGNVFSCSVMHEA<br>LHNHYTQKSLSLSPG |
| CD3W245-LH-scfv-Fc | 360 | DIQMTQSPSSLSASVGDRVTITCRARQSIGTAIHWYQQKP<br>GKAPKLLIKYASESISGVPSRFSGSGSGTDFTLTISSLQPED<br>FATYYCQQSGSWPYTFGQGTKLEIKGGSEGKSSGSGSES<br>KSTGGSEVQLVESGGGLVKPGGSLRLSCAASGFTFSRYN<br>MNWVRQAPGKGLEWVSSISTSSNYIYYADSVKGRFTFSR<br>DNAKNSLDLQMSGLRAEDTAIYYCTRGWGPFDYWGQG<br>TLVTVSSEPKSSDKTHTCPPCPAPEAAGGPSVFLFPPKPK<br>DTLMISRTPEVTCVVVSVSHEDPEVKFNWYVDGVEVHN<br>AKTKPREEQYNSTYRVVSVLTVLHQDWLNGKEYKCKVS<br>NKALPAPIEKTISKAKGQPREPQVYVYPPSREEMTKNQVS<br>LTCLVKGFYPSDIAVEWESNGQPENNYKTTPPVLDSDGS<br>FALVSKLTVDKSRWQQGNNTSCSVMHEALEINHYTQKSL<br>SLSPG |
| CD3W245-LH-scfv-Fc w/K447 | 362 | DIQMTQSPSSLSASVGDRYTITCRARQSIGTAIIIWYQQKP<br>GKAPKLLIKYASESISGVPSRFSGSGSGTDFTLTISSLQPED<br>FATYYCQQSGSWPYTFGQGTKLEIKGGSEGKSSGSGSESK<br>STGGSEVQLVESGGGLVKPGGSLRLSCAASGFTFSRYNM<br>NWVRQAPGKGLEWYSSISTSSNYTYYADSVKGRFTFSRD<br>NAKNSLDLQMSGLRAEDTAIYYCTRGWGPFDYWGQGTL<br>VTVSSEPKSSDKTHTCPPCPAPEAAGGPSVFLFPPKPKDTL<br>MISRTPEVTCVVVSVSHEDPEVKFNWYVDGVEVHNAKT<br>KPREEQYNSTYRVVSVLTVLHQDWLNGKEYKCKVSNKA<br>LPAPIEKTISKAKGQPREPQVYVYPPSREEMTKNQVSLTCL<br>VKGFYPSDIAVEWESNGQPENNYKTTPPVLDSDGSFALVS<br>KLTVDKSRWQQGNVFSCSVMHEALHNHYTQKSLSLSPG<br>K |

TABLE 38

HC and LC DNA SEQ ID NOs of hK2/CD3 bispecific antibodies

| | hK2 arm | | | CD3 arm | | |
|---|---|---|---|---|---|---|
| Bispecific Name | Name | HC1 or scFv - Fc DNA SEQ ID NO: | LC1 DNA SEQ ID NO: | Name | HC2 or scFv - Fc DNA SEQ ID NO: | LC2 DNA SEQ ID NO: |
| KLCB91 | KL2B359 LH - scFv - Fc | 363 | | CD3W245 Fab | 371 | 312 |
| KLCB105 | KL2B359 - LH - scFv - Fc | 363 | | CD3B376 Fab | 372 | 317 |
| KLCB95 | KL2B413 - LH - scFv - Fc | 364 | | CD3W245 Fab | 371 | 312 |
| KLCB96 | KL2B413-LH-scFv-Fc | 364 | | CD3B376 Fab | 372 | 317 |
| KLCB170 | KL2B467-LH-scFv-Fc | 365 | | CD3W245 Fab | 371 | 312 |
| KLCB80 | KL2B30 Fab | 367 | 303 | CD3W245-LH-scFv-Fc | 373 | |
| KLCB81 | KL2B242LC_C33S Fab | 369 | 446 | CD3W245-LH-scFv-Fc | 373 | |
| KLCB113 | KL2B53 Fab | 368 | 304 | CD3W245-LH-scFv-Fc | 373 | |
| KLCB281 | KL2B467-LH-scFv-Fc | 365 | | CD3B376 Fab | 372 | 317 |
| KLCB174 | KL2B494-LH-scFv | 366 | | CD3B376-Fab | 372 | 317 |
| KLCB153 | KL2B494-LH-scFv | 366 | | CD3W245-Fab | 371 | 312 |
| KLCB245 | KL2B30-Fab w/K447 | 370 | 303 | CD3W245-LH-scFv-Fc w/K447 | 374 | |

(KL2B359-LH-scFv-Fc)
SEQ ID NO: 363
GAGATTGTTCTCACCCAATCCCCAGCTACTCTCTCTCTTTCACCCGGTGAGCGGGCAACCCTC
TCCTGTAGAGCCAGCGAGAGCGTGGAGTATTTTGGCACATCCCTGATGCACTGGTATCAGCA
AAAACCAGGACAACCCCCCAGACTCCTCATATATGCCGCCTCAAATGTCGAGAGTGGGATA
CCTGCACGGTTTTCAGGAAGCGGCAGCGGTACTGACTTCACATTGACTATATCCTCTGTAGA
GCCAGAGGATTTTGCAGTCTACTTCTGCCAGCAAACTAGGAAGGTTCCATATACTTTTGGGG
GCGGTACAAAAGTTGAGATAAAGGGCGGCTCCGAGGGCAAGAGCAGCGGCAGCGGCAGCG
AGAGCAAGAGCACCGGCGGCAGCCAAGTACAGCTCCAGGAGTCAGGACCTGGGCTCGTCAA
ACCATCTCAGACATTGTCCCTGACATGCACAGTFTCCGGCAACAGTATTACTTCCGACTATGC
TTGGAATTGGATCAGGCAATTCCCAGGAAAGCGGCTCGAGTGGATAGGTTATATTTCTTACT
CTGGATCTACTACCTACAATCCCAGTTTGAAGTCTCGCGTGACAATTAGCCGGGACACATCA
AAAAATCAATTCTCACTTAAACTFAGTTCTGTAACCGCTGCCGATACAGCCGTGTACTACTG
CGCCACTGGTTATTATTATGGAAGCGGATTTTGGGGGCAAGGAACTTTGGTGACCGTCTCTT
CCGAGCCCAAATCTAGCGACAAAACTCACACATGTCCACCGTGCCCAGCACCTGAAGCAGC
AGGGGGACCGTCAGTCTTCCTCTTCCCCCCAAAACCCAAGGACACCCTCATGATCTCCCGGA
CCCCTGAGGTCACATGCGTGGTGGTGAGCGTGAGCCACGAAGACCCTGAGGTCAAGTTCAA
CTGGTACGTGGACGGCGTGGAGGTGCATAATGCCAAGACAAAGCCGCGGGAGGAGCAGTAC
AACAGCACGTACCGTGTGGTCAGCGTCCTCACCGTCCTGCACCAGGACTGGCTGAATGGCAA
GGAGTACAAGTGCAAGGTCTCCAACAAAGCCCTCCCAGCCCCCATCGAGAAAACCATCTCC
AAAGCCAAAGGGCAGCCCCGAGAACCACAGGTGTACGTGCTGCCCCCATCCCGGGAGGAGA
TGACCAAGAACCAGGTCAGCCTGCTGTGCCTGGTCAAAGGCTTCTATCCCAGCGACATCGCC
GTGGAGTGGGAGAGCAATGGGCAGCCGGAGAACAACTACCTCACCTGGCCTCCCGTGCTGG
ACTCCGACGGCTCCTTCTTCCTCTACAGCAAGCTCACCGTGGACAAGTCTAGATGGCAGCAG
GGGAACGTCTTCTCATGCTCCGTGATGCATGAGGCTCTGCACAACCACTACACGCAGAAGAG
CCTCFCCCTGTCTCCGGGT (KL2B413-LH-scFv-Fc)
SEQ ID NO: 364
GAGGTACAACTTGTCGAAAGTGGCGGTGGAGTCGTCCAGCCTGGGCGATCACTTCGCCTCTC
CTGTGTAGCCTCTGGTFTCACTTTCTCATCTTACGACATACACTGGGTCCGCCAGGCACCTGG
TAAGGGGCTGGAGTGGGTTGCCATCATTAGTTACGATGGCTCCAAAAAAGATTACACCGATA
GCGTAAAGGGCAGATTTACCATTTCCAGGGATAATTCAAAGAACACCCTGTATCTGCAAATG
GACAGCCTCCGCGTCGAAGACTCTGCAGTTTATAGCTGTGCCAGGGAGTCAGGCTGGTCCCA
TTATTACTATTATGGTATGGACGTTTGGGGCCAGGGAACCATGGTCACTGTTAGTTCAGCCTC
CACCAAGGGCCCATCGGTCTTCCCCCTGGCACCCTCCTCCAAGAGCACCTCTGGGGGCACAG
CGGCCCTGGGCTGCCTGGTCAAGGACTACTTCCCCGAACCGGTGACGGTGTCGTGGAACTCA
GGCGCCCTGACCAGCGGCGTGCACACCTTCCCGGCTGTCCTACAGTCCTCAGGACTCTACTC
CCTCAGCAGCGTGGTGACCGTGCCCTCCAGCAGCTTGGGCACCCAGACCTACATCTGCAACG
TGAATCACAAGCCCAGCAACACCAAGGTGGACAAGAAAGTTGAGCCCAAATCTTGTGACAA
AACTCACACATGTCCACCGTGCCCAGCACCTGAAGCAGCAGGGGGACCGTCAGTCTTCCTCT
TCCCCCCAAAACCCAAGGACACCCTCATGATCTCCCGGACCCCTGAGGTCACATGCGTGGTG
GTGAGCGTGAGCCACGAAGACCCTGAGGTCAAGTTCAACTGGTACGTGGACGGCGTGGAGG
TGCATAATGCCAAGACAAAGCCGCGGGAGGAGCAGTACAACAGCACGTACCGTGTGGTCAG

-continued

CGTCCTCACCGTCCTGCACCAGGACTGGCTGAATGGCAAGGAGTACAAGTGCAAGGTCTCCA

ACAAAGCCCTCCCAGCCCCCATCGAGAAAACCATCTCCAAAGCCAAAGGGCAGCCCCGAGA

ACCACAGGTGTACGTGCTGCCCCCATCCCGGGAGGAGATGACCAAGAACCAGGTCAGCCTG

CTGTGCCTGGTCAAAGGCTTCTATCCCAGCGACATCGCCGTGGAGTGGGAGAGCAATGGGC

AGCCGGAGAACAACTACCTCACCTGGCCTCCCGTGCTGGACTCCGACGGCTCCTTCTTCCTCT

ACAGCAAGCTCACCGTGGACAAGTCTAGATGGCAGCAGGGGAACGTCTTCTCATGCTCCGTG

ATGCATGAGGCTCTGCACAACCACTACACGCAGAAGAGCCTCTCCCTGTCTCCGGGT (KL2B467-LH-scFv-Fc)

SEQ ID NO: 365

CAGAGCGTACTTACCCAGCCTCCCAGCGTGTCTGTAGCCCCAGGACAGACAGCCAGTATTAC

ATGCGGTGGTGACAATATAGGTTCCAAATCCGTGCATTGGTACCAGCAGAAGCCAGGGCAA

GCTCCCGTGCTCGTGGTATATGATAATTCCGACCGCCCTTCCGGCATTCCCGAACGGTTTAGT

GGTTCAAATTCAGGCACCACAGCAACTCTGACCATAAGCAGAGTCGAAGCTGGAGACGAAG

CCGACTACTACTGTCAGGTATGGGACTCTAGTAGTGACCACCCTGTCGTCTTCGGTGGGGA

ACCAAAGTGACCGTTCTGGGCGGCTCCGAGGGCAAGAGCAGCGGCAGCGGCAGCGAGAGC

AAGAGCACCGGCGGCAGCCAGGTCCAGCTCGTAGAAAGTGGGGGCGGCGTAGTTCAGCCAG

GCAGGAGTCTCCGGCTGAGTTGTGCAGCCAGCGGCTTTACTTTTTCCTACTATGGAATGCACT

GGGTACGTCAGGCACCCGGCAAAGGTTTGGAGTGGGTCGCATTCATTTCTTATGATGGATCA

AATAAGTATTATGCCGATAGTGTAAAGGGCAGATTTACAATAAGTCGAGACAACTCAAAGA

ACACTCTCTACCTCCAAATGAATAGTCTTCGGGCAGAGGATACTGCAGTGTACTATTGTGCT

CATCTTCCTTATTCCGGTTCTTACTGGGCATTCGATTATTGGGGCAAGGGACACAAGTTACC

GTGTCTAGCGAGCCCAAATCTAGCGACAAAACTCACACATGTCCACCGTGCCCAGCACCTGA

AGCAGCAGGGGACCGTCAGTCTTCCTCTTCCCCCCAAAACCCAAGGACACCCTCATGATCT

CCCGGACCCCTGAGGTCACAmcGTGGTGGTGAGCGTGAGCCACGAAGACCCTGAGGTCAA

GTTCAACTGGTACGTGGACGGCGTGGAGGTGCATAATGCCAAGACAAAGCCGCGGGAGGAG

CAGTACAACAGCACGTACCGTGTGGTCAGCGTCCTCACCGTCCTGCACCAGGACTGGCTGAA

TGGCAAGGAGTACAAGTGCAAGGTCTCCAACAAAGCCCTCCCAGCCCCCATCGAGAAAACC

ATCTCCAAAGCCAAAGGGCAGCCCCGAGAACCACAGGTGTACGTGCTGCCCCCATCCCGGG

AGGAGATGACCAAGAACCAGGTCAGCCTGCTGTGCCTGGTCAAAGGCTTCTATCCCAGCGA

CATCGCCGTGGAGTGGGAGAGCAATGGGCAGCCGGAGAACAACTACCTCACCTGGCCTCCC

GTGCTGGACTCCGACGGCTCCTTCTTCCTCTACAGCAAGCTCACCGTGGACAAGTCTAGATG

GCAGCAGGGGAACGTCTTCTCATGCTCCGTGATGCATGAGGCTCTGCACAACCACTACACGC

AGAAGAGCCCTCTCCCTGTCTCCGGGT (KL2B494-LH-scFv-Fc)

SEQ ID NO: 366

AGCAGCGAATTGACCCAACCACCTTCCGTCAGCGTCGCACCAGGGCAAACCGCCCGCATCA

CATGCGGTGGGAACAATATAGGAAGCAAATCTGTCCACTGGTACCAGCAAAAACCAGGACA

AGCCCCTGTTCTGGTCGTCTATGATGACAGCGACAGACCAAGTGGTATTCCCGAGAGATTCT

CCGGTAGCAACTCTGGAAATACAGCTACTTTGACCATCTCCAGAGTTGAGGCTGGTGACGAG

GCAGATTACTATTGCCAGGTCTGGGACAGCTCCAGCGACCACGTCGTATTCGGTGGCGGGAC

CAAGCTGACTGTGCTGGGCGGCTCCGAGGGCAAGAGCAGCGGCAGCGGCAGCGAGAGCAA

GAGCACCGGCGGCAGCCAGGTGCAGTTGGTAGAGTCAGGAGGGGGCCTCGTTCAACCTGGT

-continued

GGCAGCCTCCGTTTGTCTTGTGCTGCCAGTGGATTTACTTTCAGTCACTACGCAATGAGCTGG
GTGAGACAAGCACCTGGCAAGGGCCTTGAGTGGGTCTCCACTATCGGCGGTTCAGGGGGGA
GCACTTACTACGCTGACTCTGTAAAAGGTCGCTTTACTATATCTAGAGATAACTCTAAAAAC
ACACTCTACTTGCAGATGAACAGCCTGCGAGCCGAAGATACAGCCGTGTACTACTGCGCCAA
GCCTCATATTGTAATGGTCACTGCCCTCTTGTATGATGGCATGGATGTTTGGGGCCAAGGGA
CAATGGTGACAGTCTCAAGCGAGCCCAAATCTAGCGACAAAACTCACACATGTCCACCGTG
CCCAGCACCTGAAGCAGCAGGGGACCGTCAGTCTTCCTCTTCCCCCCAAAACCCAAGGACA
CCCTCATGATCTCCCGGACCCCTGAGGTCACATGCGTGGTGGTGAGCGTGAGCCACGAAGAC
CCTGAGGTCAAGTTCAACTGGTACGTGGACGGCGTGGAGGTGCATAATGCCAAGACAAAGC
CGCGGGAGGAGCAGTACAACAGCACGTACCGTGTGGTCAGCGTCCTCACCGTCCTGCACCA
GGACTGGCTGAATGGCAAGGAGTACAAGTGCAAGGTCTCCAACAAAGCCCTCCCAGCCCCC
ATCGAGAAAACCATCTCCAAAGCCAAAGGGCAGCCCCGAGAACCACAGGTGTACGTGCTGC
CCCCATCCCGGGAGGAGATGACCAAGAACCAGGTCAGCCTGCTGTGCCTGGTCAAAGGCTT
CTATCCCAGCGACATCGCCGTGGAGTGGGAGAGCAATGGGCAGCCGGAGAACAACTACCTC
ACCTGGCCTCCCGTGCTGGACTCCGACGGCTCCTTCTTCCTCTACAGCAAGCTCACCGTGGAC
AAGTCTAGATGGCAGCAGGGGAACGTCTTCTCATGCTCCGTGATGCATGAGGCTCTGCACAA
CCACTACACGCAGAAGAGCCTCTCCCTGTCTCCGGGT (KLK2B30 Fab HC cDNA)

SEQ ID NO: 367
CAGGTTCAACTTCAAGAATCCGGGCCAGGTCTGGTCAAGCCTTCAGAGACTTTGTCCCTTAC
TTGCACAGTGAGCGGTGGCTCTATCTCAAGTTACTACTGGTCATGGATACGGCAGCCCCCAG
GAAAGGGGCTTGAGTGGATTGGGTACATTTATTACTCAGGGTCAACAAACTACAATCCCTCC
CTCAAATCCCGAGTGACAATTAGTGTCGATACATCTAAAAACCAGTTTTCCCTGAAATTGAG
CTCAGTCACCGCAGCTGATACTGCAGTCTATTATTGTGCTGGCACAACAATCTTCGGGGTAG
TAACTCCAAACTTCTACTACGGGATGGACGTGTGGGGGCAAGGAACAACCGTAACAGTAAG
TAGTGCCTCCACCAAGGGCCCATCGGTCTTCCCCCTGGCACCCTCCTCCAAGAGCACCTCTG
GGGGCACAGCGGCCCTGGGCTGCCTGGTCAAGGACTACTTCCCCGAACCGGTGACGGTGTC
GTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTAC
ATCTGCAACGTGAATCACAAGCCCAGCAACACCAAGGTGGACAAGAAAGTTGAGCCCAAAT
CTTGTGACAAAACTCACACATGTCCACCGTGCCCAGCACCTGAAGCAGCAGGGGACCGTC
AGTCTTCCTCTTCCCCCCAAAACCCAAGGACACCCTCATGATCTCCCGGACCCCTGAGGTCA
CATGCGTGGTGGTGAGCGTGAGCCACGAAGACCCTGAGGTCAAGTTCAACTGGTACGTGGA
CGGCGTGGAGGTGCATAATGCCAAGACAAAGCCGCGGGAGGAGCAGTACAACAGCACGTA
CCGTGTGGTCAGCGTCCTCACCGTCCTGCACCAGGACTGGCTGAATGGCAAGGAGTACAAGT
GCAAGGTCTCCAACAAAGCCCTCCCAGCCCCCATCGAGAAAACCATCTCCAAAGCCAAAGG
GCAGCCCCGAGAACCACAGGTGTACGTGCTGCCCCCATCCCGGGAGGAGATGACCAAGAAC
CAGGTCAGCCTGCTGTGCCTGGTCAAAGGCTTCTATCCCAGCGACATCGCCGTGGAGTGGGA
GAGCAATGGGCAGCCGGAGAACAACTACCTCACCTGGCCTCCCGTGCTGGACTCCGACGGC
TCCTTCTTCCTCTACAGCAAGCTCACCGTGGACAAGTCTAGATGGCAGCAGGGGAACGTCTT
CTCATGCTCCGTGATGCATGAGGCTCTGCACAACCACTACACGCAGAAGAGCCTCTCCCTGT
CTCCGGGT

-continued (KLK2B30 Fab LC cDNA)
SEQ ID NO: 303
GATATTCAAATGACCCAGTCACCATCATTCCTGTCCGCCTCAGTGGGAGATCGCGTCACTAT

TACTTGTCGTGCTAGCCAGGGGATATCATCATATTTGGCTTGGTATCAACAAAAGCCAGGAA

AGGCCCCAAAATTCCTTATATATGCAGCTAGTACACTCCAGAGTGGTGTTCCTAGCCGGTTC

TCTGGCAGCGGCTCAGGGACCGAGTTCACCCTGACAATCTCCAGCTTGCAGCCCGAAGACTT

TGCAACCTACTATTGCCAGCAACTGAACTCCTATCCTCTGACTTTCGGGGGAGGAACCAAGG

TTGAGATTAAACGGACAGTGGCCGCTCCTTCCGTGTTCATCTTCCCACCTTCCGACGAGCAG

CTGAAGTCCGGCACAGCTTCTGTCGTGTGCCTGCTGAACAACTTCTACCCTCGGGAAGCCAA

GGTGCAGTGGAAGGTGGACAATGCCCTGCAGTCCGGCAACTCCCAAGAGTCTGTGACCGAG

CAGGACTCCAAGGACAGCACCTACAGCCTGTCCTCCACACTGACCCTGTCCAAGGCCGACTA

CGAGAAGCACAAGGTGTACGCCTGCGAAGTGACCCATCAGGGCCTGTCTAGCCCTGTGACC

AAGTCTTTCAACCGGGGCGAGTGT (KL2853 Fab HC cDNA)
SEQ ID NO: 368
GAGGTACAACTTGTCGAAAGTGGCGGTGGAGTCGTCCAGCCTGGGCGATCACTTCGCCTCTC

CTGTGTAGCCTCTGGTTTCACTTTCTCATCTTACGACATACACTGGGTCCGCCAGGCACCTGG

TAAGGGGCTGGAGTGGGTTGCCATCATTAGTTACGATGGCTCCAAAAAAGATTACACCGATA

GCGTAAAGGGCAGATTTACCATTTCCAGGGATAATTCAAAGAACACCCTGTATCTGCAAATG

GACAGCCTCCGCGTCGAAGACTCTGCAGTTTATAGCTGTGCCAGGGAGTCAGGCTGGTCCCA

TTATTACTATTATGGTATGGACGTTTGGGGCCAGGGAACCATGGTCACTGTTAGTTCAGCCTC

CACCAAGGGCCCATCGGTCTTCCCCCTGGCACCCTCCTCCAAGAGCACCTCTGGGGGCACAG

CGGCCCTGGGCTGCCTGGTCAAGGACTACTTCCCCGAACCGGTGACGGTGTCGTGGAACTCA

GGCGCCCTGACCAGCGGCGTGCACACCTTCCCGGCTGTCCTACAGTCCTCAGGACTCTACTC

CCTCAGCAGCGTGGTGACCGTGCCCTCCAGCAGCTTGGGCACCCAGACCTACATCTGCAACG

TGAATCACAAGCCCAGCAACACCAAGGTGGACAAGAAAGTTGAGCCCAAATCTTGTGACAA

AACTCACACATGTCCACCGTGCCCAGCACCTGAAGCAGCAGGGGGACCGTCAGTCTTCCTCT

TCCCCCCAAAACCCAAGGACACCCTCATGATCTCCCGGACCCCTGAGGTCACATGCGTGGTG

GTGAGCGTGAGCCACGAAGACCCTGAGGTCAAGTTCAACTGGTACGTGGACGGCGTGGAGG

TGCATAATGCCAAGACAAAGCCGCGGGAGGAGCAGTACAACAGCACGTACCGTGTGGTCAG

CGTCCTCACCGTCCTGCACCAGGACTGGCTGAATGGCAAGGAGTACAAGTGCAAGGTCTCCA

ACAAAGCCCTCCCAGCCCCCATCGAGAAAACCATCTCCAAAGCCAAAGGGCAGCCCCGAGA

ACCACAGGTGTACGTGCTGCCCCCATCCCGGGAGGAGATGACCAAGAACCAGGTCAGCCTG

CTGTGCCTGGTCAAAGGCTTCTATCCCAGCGACATCGCCGTGGAGTGGGAGAGCAATGGGC

AGCCGGAGAACAACTACCTCACCTGGCCTCCCGTGCTGGACTCCGACGGCTCCTTCTTCCTCT

ACAGCAAGCTCACCGTGGACAAGTCTAGATGGCAGCAGGGGAACGTCTTCTCATGCTCCGTG

ATGCATGAGGCTCTGCACAACCACTACACGCAGAAGAGCCTCTCCCTGTCTCCGGGT (KL2B53 Fab LC cDNA)
SEQ ID NO: 304
GATATTGTAATGACTCAGTCACCCTCTTCACTGAGTGCATCAGTAGGTGATCGCGTTACCATC

ACTTGCCGTGCCAGTCAAGACATTTCAAATTACCTTGCATGGTACCAACAAAAGCCCGGAAA

AGTGCCAAAGTTTTTGATTTATGCCGCTTCAACACTCCATTCAGGAGTGCCCTCTCGTTTCAG

TGGATCTGGCAGTGGCACCGATTTTACTCTCACAATAAGCAGTCTCCAGCCTGAGGATGTAG

-continued

CCACCTATTATTGCCAAAAATATAATTCAGCCCCCTATACTTTTGGACAGGGCACACGCCTT

GAGATTAAACGGACAGTGGCCGCTCCTTCCGTGTTCATCTTCCCACCTTCCGACGAGCAGCT

GAAGTCCGGCACAGCTTCTGTCGTGTGCCTGCTGAACAACTTCTACCCTCGGGAAGCCAAGG

TGCAGTGGAAGGTGGACAATGCCCTGCAGTCCGGCAACTCCCAAGAGTCTGTGACCGAGCA

GGACTCCAAGGACAGCACCTACAGCCTGTCCTCCACACTGACCCTGTCCAAGGCCGACTACG

AGAAGCACAAGGTGTACGCCTGCGAAGTGACCCATCAGGGCCTGTCTAGCCCTGTGACCAA

GTCTTTCAACCGGGGCGAGTGT (KLK2B242 Fab HC cDNA and KL2B242LC_C33S Fab HC)

SEQ ID NO: 369

CAAGTACAACTTCAAGAGTCTGGCCCTGGGCTTGTTAAGCCCTCAGAGACCTTGTCACTGAC

CTGTACCGTATCAGGCGGGTCAATTTCATCTTACTACTGGAGTTGGCTTCGTCAGCCTGCCGG

ATCTGGACTGGAGTGGATAGGTAGACTGTATGTTTCCGGCTTTACAAATTACAACCCATCTTT

GAAAAGCCGTGTGACTCTCAGCCTCGACCCTTCTCGGAATCAACTTTCACTTAAATTGTCTTC

TGTTACAGCTGCCGACACTGCAGTATATTATTGTGCAGGGGACTCAGGCAACTATTGGGGAT

GGTTTGATCCTTGGGGGCAGGGGACCCTGGTAACCGTGAGTTCTGCCTCCACCAAGGGCCCA

TCGGTCTTCCCCCTGGCACCCTCCTCCAAGAGCACCTCTGGGGGCACAGCGGCCCTGGGCTG

CCTGGTCAAGGACTACTTCCCCGAACCGGTGACGGTGTCGTGGAACTCAGGCGCCCTGACCA

GCGGCGTGCACACCTTCCCGGCTGTCCTACAGTCCTCAGGACTCTACTCCCTCAGCAGCGTG

GTGACCGTGCCCTCCAGCAGCTTGGGCACCCAGACCTACATCTGCAACGTGAATCACAAGCC

CAGCAACACCAAGGTGGACAAGAAAGTTGAGCCCAAATCTTGTGACAAAACTCACACATGT

CCACCGTGCCCAGCACCTGAAGCAGCAGGGGACCGTCAGTCTTCCTCTTCCCCCCAAAACC

CAAGGACACCCTCATGATCTCCCGGACCCCTGAGGTCACATGCGTGGTGGTGAGCGTGAGCC

ACGAAGACCCTGAGGTCAAGTTCAACTGGTACGTGGACGGCGTGGAGGTGCATAATGCCAA

GACAAAGCCGCGGGAGGAGCAGTACAACAGCACGTACCGTGTGGTCAGCGTCCTCACCGTC

CTGCACCAGGACTGGCTGAATGGCAAGGAGTACAAGTGCAAGGTCTCCAACAAAGCCCTCC

CAGCCCCCATCGAGAAAACCATCTCCAAAGCCAAAGGGCAGCCCCGAGAACCACAGGTGTA

CGTGCTGCCCCCATCCCGGGAGGAGATGACCAAGAACCAGGTCAGCCTGCTGTGCCTGGTCA

AAGGCTTCTATCCCAGCGACATCGCCGTGGAGTGGGAGAGCAATGGGCAGCCGGAGAACAA

CTACCTCACCTGGCCTCCCGTGCTGGACTCCGACGGCTCCTTMCCTCTACAGCAAGCTCAC

CGTGGACAAGTCTAGATGGCAGCAGGGGAACGTCTTCTCATGCTCCGTGATGCATGAGGCTC

TGCACAACCACTACACGCAGAAGAGCCTCTCCCTGTCTCCGGGT (KLK2B242LC_C33S Fab LC cDNA)

SEQ ID NO: 446

AGTTATGAGCTGACTCAACCACCCAGTGTCAGCGTATCCCCAGGAGAAACTGCCTCTATAAC

ATGCAGCGGAGACCAGTTGGGAGAAAATTACGCCTCCTGGTACCAACAGAAGCCTGGACAA

AGTCCTGTCCTCGTTATTTATCAAGATTCTAAACGTCCCTCTGGGATCCCCGAACGATTCTCC

GGCTCTAACTCTGGGAATACCGCTACCTTGACAATAAGTGGTACACAGGCACTTGATGAAGC

TGATTATTACTGCCAGGCATGGGATAACAGCATTGTGGTTTTCGGGGGCGGCACCAAACTCA

CAGTTCTCGGTCAGCCCAAGGCTGCACCCAGTGTCACTCTGTTCCCGCCCTCCTCTGAGGAG

CTTCAAGCCAACAAGGCCACACTGGTGTGTCTCATAAGTGACTTCTACCCGGGAGCCGTGAC

AGTGGCCTGGAAGGCCGATAGCAGCCCCGTCAAGGCGGGAGTGGAGACCACCACACCCTCC

AAACAAAGCAACAACAAGTACGCGGCCAGCAGCTATCTGAGCCTGACGCCTGAGCAGTGGA

AGTCCCACAGAAGCTACAGCTGCCAGGTCACGCATGAAGGGAGCACCGTGGAGAAGACAGT

GGCCCCTACAGAATGTTCA (KLK2B30 wK477 Fab HC cDNA)

SEQ ID NO: 370

CAGGTTCAGCTGCAAGAGTCTGGCCCTGGCCTGGTCAAGCCTTCCGAGACACTGTCTCTGAC

CTGCACCGTGTCTGGCGGCTCCATCTCCTCCTACTACTGGTCCTGGATCAGACAGCCTCCTGG

CAAAGGCCTGGAATGGATCGGCTACATCTACTACTCCGGCTCCACCAACTACAACCCCAGCC

TGAAGTCCAGAGTGACCATCTCCGTGGACACCTCCAAGAACCAGTTCTCCCTGAAGCTGTCC

TCCGTGACCGCTGCTGATACCGCCGTGTACTATTGTGCTGGCACCACCATCTTCGGCGTGGTC

ACCCCTAACTTCTACTACGGCATGGACGTGTGGGGCCAAGGCACAACAGTGACAGTCTCTTC

TGCCTCCACCAAGGGTCCATCGGTCTTCCCCCTGGCACCCTCCTCCAAGAGCACCTCTGGGG

GCACAGCGGCCCTGGGCTGCCTGGTCAAGGACTACTTCCCCGAACCGGTGACGGTGTCGTGG

AACTCAGGCGCCCTGACCAGCGGCGTGCACACCTTCCCGGCTGTCCTACAGTCCTCAGGACT

CTACTCCCTCAGCAGCGTGGTGACCGTGCCCTCCAGCAGCTTGGGCACCCAGACCTACATCT

GCAACGTGAATCACAAGCCCAGCAACACCAAGGTGGACAAGAAAGTTGAGCCCAAATCTTG

TGACAAAACTCACACTTGTCCACCGTGCCCAGCACCTGAAGCAGCAGGGGGACCGTCAGTCT

TCCTCTTCCCCCCAAAACCCAAGGACACCCTCATGATCTCCCGGACCCCTGAGGTCACATGC

GTGGTGGTGAGCGTGAGCCACGAAGACCCTGAGGTCAAGTTCAACTGGTACGTGGACGGCG

TGGAGGTGCATAATGCCAAGACAAAGCCGCGGGAGGAGCAGTACAACAGCACGTACCGTGT

GGTCAGCGTCCTCACCGTCCTGCACCAGGACTGGCTGAATGGCAAGGAGTACAAGTGCAAG

GTGTCCAACAAAGCCCTCCCAGCCCCCATCGAGAAAACCATCTCCAAAGCCAAAGGGCAGC

CCCGAGAACCACAGGTGTACGTGCTGCCCCCATCCCGGGAGGAGATGACCAAGAACCAGGT

CAGCCTGCTGTGCCTGGTCAAAGGCTTCTATCCCAGCGACATCGCCGTGGAGTGGGAGAGCA

ATGGGCAGCCGGAGAACAACTACCTCACCTGGCCTCCCGTGCTGGACTCCGACGGCTCCTTC

TTCCTCTACAGCAAGCTCACCGTGGACAAGTCCAGATGGCAGCAGGGGAACGTCTTCTCATG

CTCCGTGATGCATGAGGCTCTGCACAACCACTACACGCAGAAGTCTCTCTCCCTGTCTCCGG

GAAAA (CD3W245-LH-scFv-Fc cDNA)

SEQ ID NO: 373

GACATACAAATGACACAATCACCCTCTTCTCTTTCTGCAAGCGTTGGCGACCGTGTCACTATC

ACTTGTCGAGCCCGCCAGTCCATAGGTACTGCCATTCACTGGTATCAACAGAAGCCTGGCAA

GGCTCCCAAACTCCTGATTAAGTATGCCAGCGAGAGCATTTCCGGCGTACCTTCAAGATTTT

CCGGCTCCGGTAGTGGGACAGATTTCACTCTCACTATATCTAGCCTCCAACCAGAAGATTTC

GCCACTTACTACTGTCAACAATCAGGTTCATGGCCTTACACTTTCGGCCAGGGGACAAAATT

GGAGATCAAGGGCGGCTCCGAGGGCAAGAGCAGCGGCAGCGGCAGCGAGAGCAAGAGCAC

CGGCGGCAGCGAGGTGCAACTGGTGGAGTCTGGGGGAGGCCTGGTCAAGCCTGGGGGGTCC

CTGAGACTCTCCTGTGCAGCCTCTGGATTCACCTTCAGTAGATATAACATGAACTGGGTCCG

CCAGGCTCCAGGGAAGGGGCTGGAGTGGGTCTCATCCATTAGTACTAGTAGTAATTACATAT

ACTACGCAGACTCAGTGAAGGGCCGATTCACCTTCTCCAGAGACAACGCCAAGAACTCACT

GGATCTGCAAATGAGCGGCCTGAGAGCCGAGGACACGGCTATTTATTACTGTACGAGAGGC

TGGGGGCCTTTTGACTACTGGGGCCAGGGAACCCTGGTCACCGTCTCCTCAGAGCCCAAATC

-continued

TAGCGACAAAACTCACACATGTCCACCGTGCCCAGCACCTGAAGCAGCAGGGGACCGTCA

GTCTTCCTCTTCCCCCCAAAACCCAAGGACACCCTCATGATCTCCCGGACCCCTGAGGTCAC

ATGCGTGGTGGTGAGCGTGAGCCACGAAGACCCTGAGGTCAAGTTCAACTGGTACGTGGAC

GGCGTGGAGGTGCATAATGCCAAGACAAAGCCGCGGGAGGAGCAGTACAACAGCACGTAC

CGTGTGGTCAGCGTCCTCACCGTCCTGCACCAGGACTGGCTGAATGGCAAGGAGTACAAGTG

CAAGGTCTCCAACAAAGCCCTCCCAGCCCCCATCGAGAAAACCATCTCCAAAGCCAAAGGG

CAGCCCCGAGAACCACAGGTGTACGTGTACCCCCCATCCCGGGAGGAGATGACCAAGAACC

AGGTCAGCCTGACCTGCCTGGTCAAAGGCTTCTATCCCAGCGACATCGCCGTGGAGTGGGAG

AGCAATGGGCAGCCGGAGAACAACTACAAGACCACGCCTCCCGTGCTGGACTCCGACGGCT

CCTTCGCCCTCGTGAGCAAGCTCACCGTGGACAAGTCTAGATGGCAGCAGGGGAACGTCTTC

TCATGCTCCGTGATGCATGAGGCTCTGCACAACCACTACACGCAGAAGAGCCTCTCCCTGTC

TCCGGGT (CD3W245-LH-scFv-Fc w/ K447)
SEQ ID NO: 374
GACATCCAGATGACCCAGTCTCCATCCTCTCTGTCCGCCTCTGTGGGCGACAGAGTGACCAT

TACCTGCCGGGCCAGACAGTCTATCGGCACCGCTATCCACTGGTATCAGCAGAAGCCTGGCA

AGGCCCCTAAGCTGCTGATTAAGTACGCCTCCGAGTCCATCTCCGGCGTGCCCTCCAGATTTT

CTGGCTCTGGATCTGGCACCGACTTTACCCTGACAATCTCCAGCCTGCAGCCTGAGGACTTC

GCCACCTACTACTGTCAGCAGTCCGGCTCTTGGCCTTACACCTTTGGTCAGGGCACCAAGCT

GGAAATCAAGGGCGGATCTGAGGGAAAGTCCAGCGGCTCCGGCAGCGAAAGCAAGTCCACC

GGCGGAAGCGAGGTGCAGCTGGTTGAATCTGGCGGAGGACTGGTTAAGCCTGGCGGCTCTC

TGAGACTGTCTTGTGCTGCTTCTGGCTTCACCTTCAGCCGGTACAACATGAACTGGGTCCGAC

AGGCTCCTGGCAAAGGCCTGGAATGGGTGTCCTCCATCTCCACCTCCAGCAACTACATCTAC

TACGCCGACTCCGTGAAGGGCAGATTCA CCTTCTCCAGAGACAACGCCAAGAACTCCCTGGA

CCTGCAGATGTCTGGCCTGAGAGCTGAGGACACCGCTATCTACTACTGCACCAGAGGCTGGG

GACCCTTCGATTATTGGGGCCAGGGAACCCTGGTCACCGTGTCATCTGAGCCCAAATCTAGC

GACAAAACTCACACTTGTCCACCGTGCCCAGCACCTGAAGCAGCAGGGGACCGTCAGTCTT

CCTCTTCCCCCCAAAACCCAAGGACACCCTCATGATCTCCCGGACCCCTGAGGTCACATGCG

TGGTGGTGAGCGTGAGCCACGAAGACCCTGAGGTCAAGTTCAACTGGTACGTGGACGGCGT

GGAGGTGCATAATGCCAAGACAAAGCCGCGGGAGGAGCAGTACAACAGCACGTACCGTGTG

GTCAGCGTCCTCACCGTCCTGCACCAGGACTGGCTGAATGGCAAGGAGTACAAGTGCAAGG

TGTCCAACAAAGCCCTCCCAGCCCCCATCGAGAAAACCATCTCCAAAGCCAAAGGGCAGCC

CCGAGAACCACAGGTGTACGTGTACCCCCCATCCCGGGAGGAGATGACCAAGAACCAGGTC

AGCCTGACCTGCCTGGTCAAAGGCTTCTATCCCAGCGACATCGCCGTGGAGTGGGAGAGCA

ATGGGCAGCCGGAGAACAACTACAAGACC.ACGCCTCCCGTGCTGGACTCCGACGGCTCCTTC

GCCCTCGTGAGCAAGCTCACCGTGGACAAGTCCAGATGGCAGCAGGGGAACGTCTTCTCAT

GCTCCGTGATGCATGAGGCTCTGCACAACCACTACACGCAGAAGTCTCTCTCCCTGTCTCCG

GGAAAA (CD3W245 Fab-HC-Fc)
SEQ ID NO: 371
GAGGTGCAACTGGTGGAGTCTGGGGGAGGCCTGGTCAAGCCTGGGGGGTCCCTGAGACTCT

CCTGTGCAGCCTCTGGATTCACCTTCAGTAGATATAACATGAACTGGGTCCGCCAGGCTCCA

GGGAAGGGGCTGGAGTGGGTCTCATCCATTAGTACTAGTAGTAATTACATATACTACGCAGA

```
CTCAGTGAAGGGCCGATTCACCTTCTCCAGAGACAACGCCAAGAACTCACTGGATCTGCAAA
TGAGCGGCCTGAGAGCCGAGGACACGGCTATTTATTACTGTACGAGAGGCTGGGGGCCTTTT
GACTACTGGGGCCAGGGAACCCTGGTCACCGTCTCCTCAGCCTCCACCAAGGGCCCATCGGT
CTTCCCCCTGGCACCcrcCTCCAAGAGCACCTCTGGGGGCACAGCGGCCCTGGGCTGCCTGG
TCAAGGACTACTTCCCCGAACCGGTGACGGTGTCGTGGAACTCAGGCGCCCTGACCAGCGGC
GTGCACACCTTCCCGGCTGTCCTACAGTCCTCAGGACTCTACTCCCTCAGCAGCGTGGTGAC
CGTGCCCTCCAGCAGCTTGGGCACCCAGACCTACATCTGCAACGTGAATCACAAGCCCAGCA
ACACCAAGGTGGACAAGAAAGTTGAGCCCAAATCTTGTGACAAAACTCACACATGTCCACC
GTGCCCAGCACCTGAAGCAGCAGGGGACCGTCAGTCTTCCTCTTCCCCCCAAAACCCAAGG
ACACCCTCATGATCTCCCGGACCCCTGAGGTCACATGCGTGGTGGTGAGCGTGAGCCACGAA
GACCCTGAGGTCAAGTTCAACTGGTACGTGGACGGCGTGGAGGTGCATAATGCCAAGACAA
AGCCGCGGGAGGAGCAGTACAACAGCACGTACCGTGTGGTCAGCGTCCTCACCGTCCTGCA
CCAGGACTGGCTGAATGGCAAGGAGTACAAGTGCAAGGTCTCCAACAAAGCCCTCCCAGCC
CCCATCGAGAAAACCATCTCCAAAGCCAAAGGGCAGCCCCGAGAACCACAGGTGTACGTGT
ACCCCCCATCCCGGGAGGAGATGACCAAGAACCAGGTCAGCCTGACCTGCCTGGTCAAAGG
CTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCGCCCTCGTGAGCAAGCTCACCGT
GGACAAGTCTAGATGGCAGCAGGGGAACGTCTTCTCATGCTCCGTGATGCATGAGGCTCTGC
ACAACCACTACACGCAGAAGAGCCTCTCCCTGTCTCCGGGT
(CD3W245 Fab-LC-Fc)
                                              SEQ ID NO: 312
GACATACAAATGACACAATCACCCTCTTCTCTTTCTGCAAGCGTTGGCGACCGTGTCACTATC
ACTTGTCGAGCCCGCCAGTCCATAGGTACTGCCATTCACTGGTATCAACAGAAGCCTGGCAA
GGCTCCCAAACTCCTGATTAAGTATGCCAGCGAGAGCATTTCCGGCGTACCTTCAAGATTTT
CCGGCTCCGGTAGTGGGACAGATTTCACTCTCACTATATCTAGCCTCCAACCAGAAGATTTC
GCCACTTACTACTGTCAACAATCAGGTTCATGGCCTTACACTTTCGGCCAGGGGACAAAATT
GGAGATCAAGCGGACAGTGGCCGCTCCTTCCGTGTTCATCTTCCCACCTTCCGACGAGCAGC
TGAAGTCCGGCACAGCTTCTGTCGTGTGCCTGCTGAACAACTTCTACCCTCGGGAAGCCAAG
GTGCAGTGGAAGGTGGACAATGCCCTGCAGTCCGGCAACTCCCAAGAGTCTGTGACCGAGC
AGGACTCCAAGGACAGCACCTACAGCCTGTCCTCCACACTGACCCTGTCCAAGGCCGACTAC
GAGAAGCACAAGGTGTACGCCTGCGAAGTGACCCATCAGGGCCTGTCTAGCCCTGTGACCA
AGTCTTTCAACCGGGGCGAGTGT
(CD3B376 Fab-HC-Fc)
                                              SEQ ID NO: 372
CAGGTGCAGCTCCAACAGAGTGGTCCCAGACTCGTGAGACCCTCTCAAACACTCAGTTTGAC
TTGTGCCATCTCAGGCGATTCAGTTTTCAACAACAATGCAGCTTGGAGCTGGATTAGGCAGT
CACCTAGTCGCGGTCTTGAATGGCTTGGGCGTACATACTATCGCTCTAAATGGTTGTATGATT
ACGCTGTGTCCGTGAAGAGCCGAATCACCGTAAACCCTGATACCTCCAGGAATCAGTTCACA
TTGCAACTGAATAGTGTGACTCCCGAGGATACTGCACTCTATTATTGTGCCCGAGGATATAG
CAGTAGCTTCGACTATTGGGGACAAGGGACACTCGTTACCGTTAGTTCAGCCTCCACCAAGG
GCCCATCGGTCTTVCCCCTGGCACCCTCCTCCAAGAGCACCTCTGGGGGCACAGCGGCCCTG
GGCTGCCTGGTCAAGGACTACTTCCCCGAACCGGTGACGGTGTCGTGGAACTCAGGCGCCCT
```

-continued
```
GACCAGCGGCGTGCACACCTTCCCGGCTGTCCTACAGTCCTCAGGACTCTACTCCCTCAGCA

GCGTGGTGACCGTGCCCTCCAGCAGCTTGGGCACCCAGACCTACATCTGCAACGTGAATCAC

AAGCCCAGCAACACCAAGGTGGACAAGAAAGTTGAGCCCAAATCTTGTGACAAAACTCACA

CATGTCCACCGTGCCCAGCACCTGAAGCAGCAGGGGACCGTCAGTCTTCCTCTTCCCCCCA

AAACCCAAGGACACCCTCATGATCTCCCGGACCCCTGAGGTCACATGCGTGGTGGTGAGCGT

GAGCCACGAAGACCCTGAGGTCAAGTTCAACTGGTACGTGGACGGCGTGGAGGTGCATAAT

GCCAAGACAAAGCCGCGGGAGGAGCAGTACAACAGCACGTACCGTGTGGTCAGCGTCCTCA

CCGTCCTGCACCAGGACTGGCTGAATGGCAAGGAGTACAAGTGCAAGGTCTCCAACAAAGC

CCTCCCAGCCCCCATCGAGAAAACCATCTCCAAAGCCAAAGGGCAGCCCCGAGAACCACAG

GTGTACGTGTACCCCCCATCCCGGGAGGAGATGACCAAGAACCAGGTCAGCCTGACCTGCCT

GGTCAAAGGCTTCTATCCCAGCGACATCGCCGTGGAGTGGGAGAGCAATGGGCAGCCGGAG

AACAACTACAAGACCACGCCTCCCGTGCTGGACTCCGACGGCTCCTTCGCCCTCGTGAGCAA

GCTCACCGTGGACAAGTCTAGATGGCAGCAGGGGAACGTCTTCTCATGCTCCGTGATGCATG

AGGCTCTGCACAACCACTACACGCAGAAGAGCCTCTCCCTGTCTCCGGGT (CD3B376 Fab-LC-Fc)
                                                        SEQ ID NO: 317
CAGTCTGCTCTGACCCAGCCTGCCTCCGTGTCTGGCTCTCCCGGCCAGTCCATCACCATCAGC

TGTACCGGCACCTCCTCCAACATCGGCACCTACAAGTTCGTGTCCTGGTATCAGCAGCACCC

CGACAAGGCCCCCAAAGTGCTGCTGTACGAGGTGTCCAAGCGGCCCTCTGGCGTGTCCTCCA

GATTCTCCGGCTCCAAGTCTGGCAACACCGCCTCCCTGACCATCAGCGGACTGCAGGCTGAG

GACCAGGCCGACTACCACTGTGTGTCCTACGCTGGCTCTGGCACCCTGCTGTTTGGCGGAGG

CACCAAGCTGACCGTGCTGGGTCAGCCCAAGGCTGCACCCAGTGTCACTCTGTTCCCGCCCT

CCTCTGAGGAGCTTCAAGCCAACAAGGCCACACTGGTGTGTCTCATAAGTGACTTCTACCCG

GGAGCCGTGACAGTGGCCTGGAAGGCCGATAGCAGCCCCGTCAAGGCGGGAGTGGAGACCA

CCACACCCTCCAAACAAAGCAACAACAAGTACGCGGCCAGCAGCTATCTGAGCCTGACGCC

TGAGCAGTGGAAGTCCCACAGAAGCTACAGCTGCCAGGTCACGCATGAAGGGAGCACCGTG

GAGAAGACAGTGGCCCCTACAGAATGTTCA
```

Example 6: Biophysical Characterization of hK2×CD3 Bi-Specific Antibodies

Affinity of Selected hK2×CD3 Bispecific Antibodies

Affinity of selected hK2×CD3 bispecific antibodies to hK2 or human CD3 was measured by surface plasmon resonance (SPR). SPR is a label-free technique to study the strength of an interaction between two binding partners by measuring the change in mass upon complex formation and dissociation. Antibodies were captured on a sensor chip coated with an anti-Fc antibody followed by injection of soluble hK2 or soluble recombinant human CD3 at various concentrations and specified association and dissociation times. Post dissociation, the surface was regenerated with an appropriate solution to prepare for the next interaction. Kinetic information (on-rate and off-rate constants) were extracted by fitting sensorgrams to the 1:1 Langmuir model. Binding affinity (KD) are reported as the ratio of rate constants (koff/kon). KD values of selected hK2/CD3 bispecific antibodies are listed in Table 39.

TABLE 39

$K_D$ values of selected hK2/CD3 bispecific antibodies for the respective binding arms

| KLK2 arm | $K_D$ (nM) |
|---|---|
| KL2B467 Fab | 0.09 |
| KL2B494 Fab | 0.06 |
| KL2B359-LH-scFv | 0.63 |
| KL2B413-LH-scFv | 16.4 |
| CD3B376 Fab | 20-40 |
| CD3W245 Fab | 0.14 |
| CD3W245 LH scFv | 20-30 |
| KL2B30 Fab | 2 |
| KL2B53 Fab | 0.1 |
| KL2B242 Fab | 0.14 |

Thermal Stability of Selected hK2×CD3 Bispecific Antibodies

Thermal stability of the bispecific antibody samples was determined by NanoDSF method using an automated Prometheus instrument. Measurements were made by loading sample into 24 well capillary from a 384 well sample plate.

Duplicate runs were performed for each sample. Prometheus NanoDSF user interface (Melting Scan tab) was used to set up the experimental parameters for the run. The thermal scans for the samples span from 20° C. to 95° C. at a rate of 1.0° C./minute. Dual-UV technology monitors intrinsic tryptophan and tyrosine fluorescence at the emission wavelengths of 330 nm and 350 nm, and this ratio (F350 nm/F330 nm) is plotted against temperature to generate an unfolding curve. Nano DSF is used for measuring Tm of all molecules at 0.5 mg/mL concentration in Phosphate Buffered Saline, pH 7.4. Measured Tm values are listed in Table 40.

TABLE 40

Tm values for KLK2 or CD3 binding arms of selected hK2 × CD3 bispecific antibodies.

| Molecule | Tm (° C.) by DSF |
|---|---|
| KL2B413 (scFv) | 67 |
| KL2B359 (scFv) | 67 |
| KL2B30 (Fab) | >70 |
| KL2B242 (Fab) | >70 |
| KL2B53 (Fab) | >70 |
| KL2B467 (Fab) | >70 |
| KL2B494 (Fab) | >70 |
| CD3B376 (Fab) | 61 |
| CD3W245 LH scFv | 66 |

Self-Association Potential by AC-SINS (Affinity Capture-Self Interaction Nanoparticle Spectroscopy)

A high throughput screening assay was used to measure the propensity of an Ab candidate to self-interact. Propensity for self-interaction usually translates into poor Ab solubility and challenges in downstream Ab manufacturing. In this assay, gold nanoparticles (AuNPs) are coated with goat anti-human IgG (H+L) capture antibody and later incubated with candidate Abs in the presence of polyclonal goat IgG. Any candidate Ab that self-associates brings the AuNPs into proximity, resulting in a shift of the nanoparticles' plasmon wavelength ($\lambda_p$), also referred to as the wavelength at maximum absorbance ($\lambda_{max}$). The magnitude of the shift ($\Delta\lambda$max) for each candidate Ab is indicative of the strength of its self-association. Proper control antibodies are used in this assay that show none to high self-association potential. All molecules tested in this assay showed none to low risks for self-association.

Example 7: In Vitro and In Vivo Characterization of Bispecific hK2×CD3 Antibodies In Vitro Cytotoxicity of hK2×CD3 Bi-Specific Antibodies The cytotoxicity potential of the generated bispecific antibodies was measured in vitro by T-cell-mediated cytotoxicity assay using live-time lapse imaging on the Incucyte platform. The bispecific antibodies were tested in hK2 positive cell line VCaP cells, in the presence of isolated pan human CD3+ T cells from healthy donors at a Effector: Target ratio (E:T ratio) of 3:1. Cell death by apoptosis was monitored by measuring the fluorescence signal from a dye which is stably expressed by target VCaP cells.

Figure 8A:
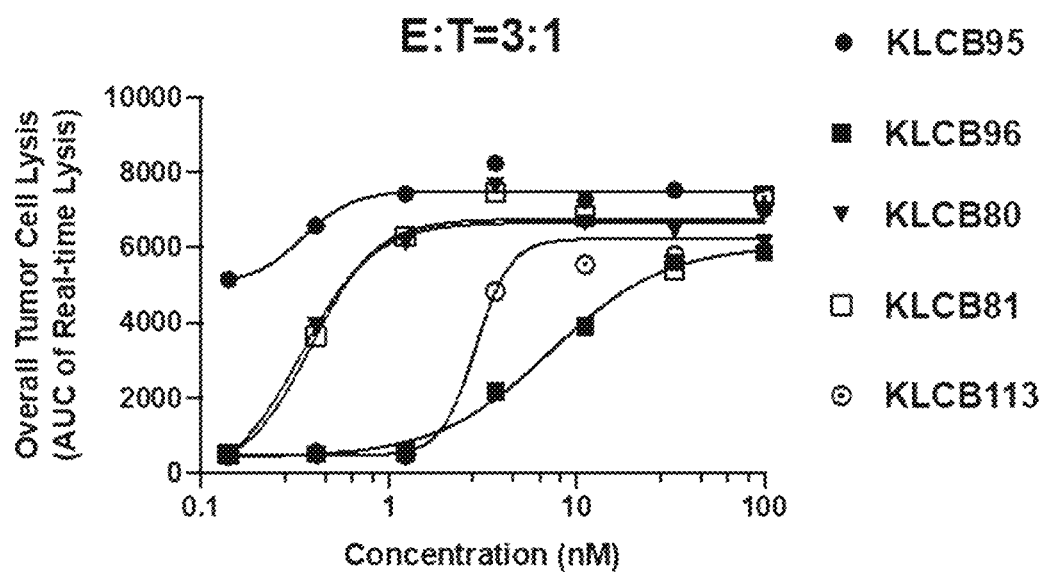
FIG. 8A shows in vitro target cytotoxicity of KL2B×CD3 bi-specific molecules measured by incuCyte imaging system in real-time for quantifying target cell death.
Figure 8B:
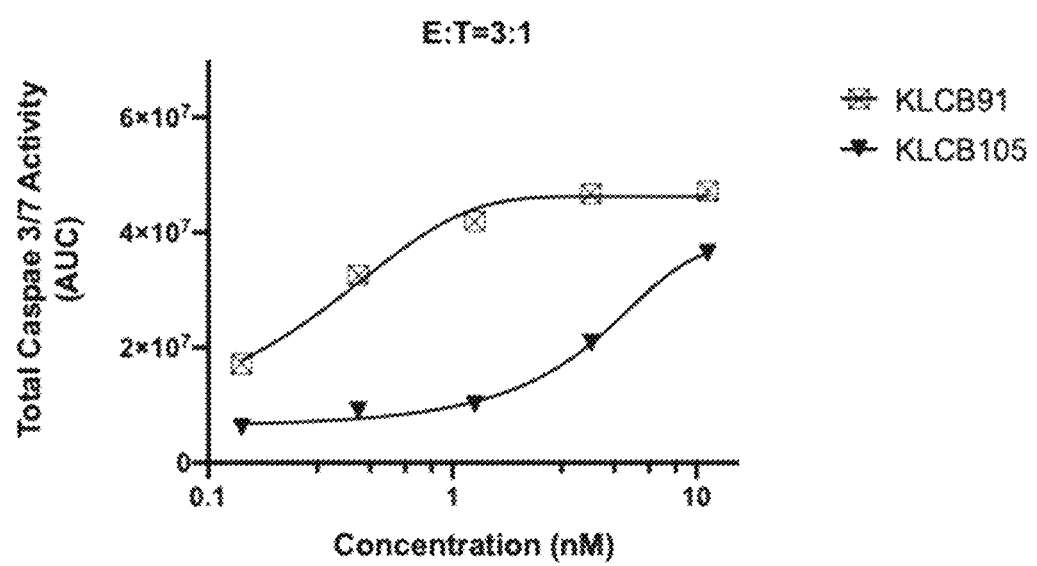
FIG. 8B shows in vitro target cytotoxicity of KL2B×CD3 bi-specific molecules measured by fluorescent caspase 3/7 reagent to measure apoptosis signal from target cell death.

Normal donor pan T cells were co-incubated with KLK2+ VCaP cells. KLK2×CD3 bispecific antibodies were dosed from 0 to 100 nM for 96 hours. 3:1 Effector-to-Target (ET) ratio was used. FIG. 8A shows in vitro target cytotoxicity of KL2B×CD3 bi-specific molecules measured by incuCyte imaging system in real-time for quantifying target cell death. Target cells were stably expressing a red nuclear dye which was measured by IncuCyte imaging system in real-time for quantifying target cell death. Overall tumor cell lysis was graphed based on AUC of real-time kinetic killing curve of VCaP cells (FIG. 8A). FIG. 8B shows in vitro target cytotoxicity of KL2B×CD3 bi-specific molecules measured by fluorescent caspase 3/7 reagent to measure apoptosis signal from target cell death. Green fluorescent Caspase 3/7 reagent was used to measure apoptosis signal from target cell death. Total Caspase 3/7 activity was graphed based on AUC of real-time caspase 3/7 activity curve (FIG. 8B). The data shows that bispecific hK2/CD3 antibodies promote a dose-dependent reduction of viable VCaP cells with increasing time and hence induce T cell mediated death of the VCaP tumor cells. bispecific hK2×CD3 antibodies are therefore effective at mediating T cell activation and show dose-dependent KLK2+ tumor cell killing.

Figure 9A:
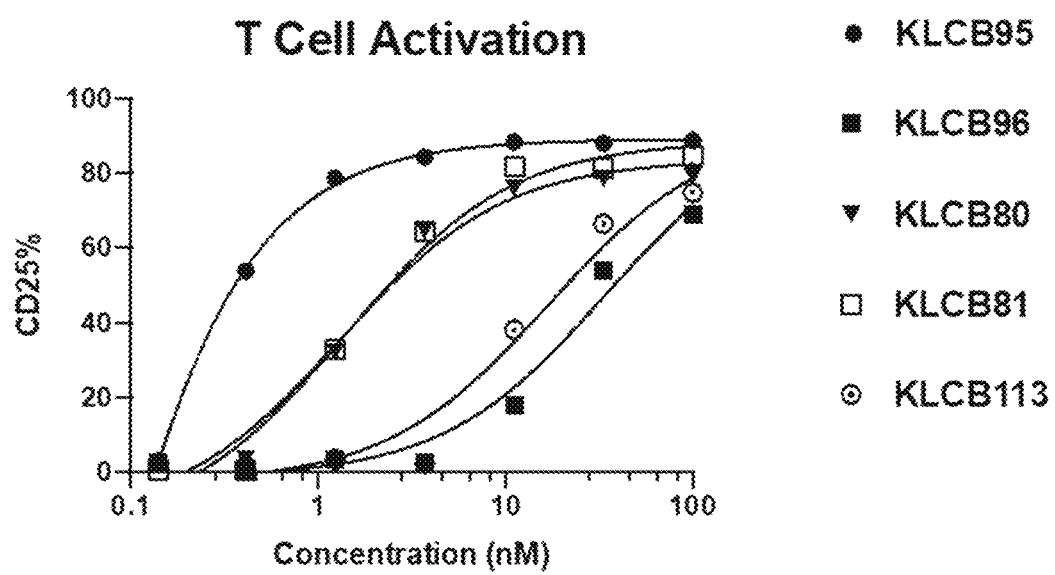
FIG. 9A shows in vitro T cell activation and proliferation by KLK2×CD3 bi-specific antibodies by showing the frequency of CD25 positive cells at different doses.
Figure 9B:
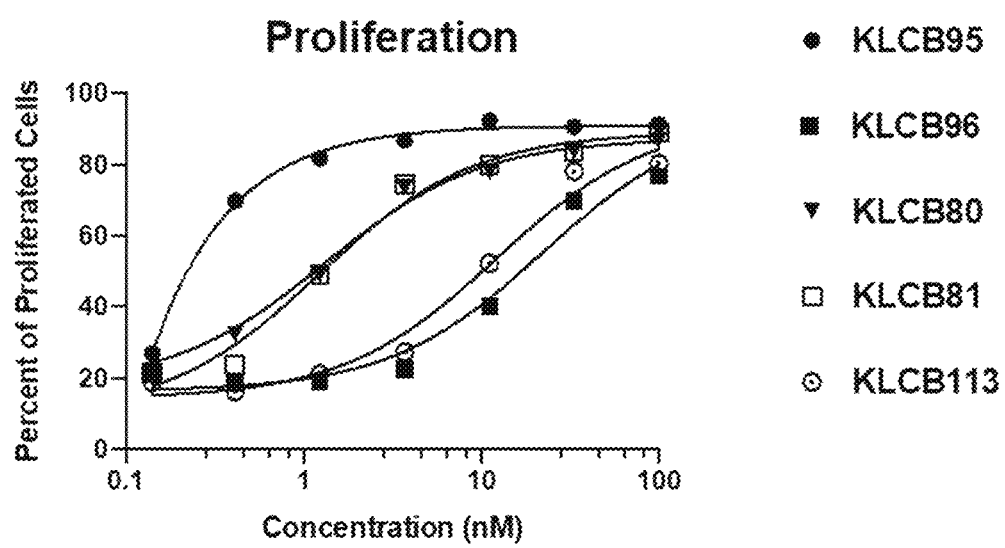
FIG. 9B shows in vitro T cell activation and proliferation by KLK2×CD3 bi-specific antibodies by showing the frequency of cells entering into proliferation gate.

In Vitro T Cell Activation and Proliferation by hK2×CD3 Bi-Specific Molecules hK2×CD3 bispecific antibodies were tested for their ability to promote T cell activation and proliferation. Normal donor pan T cells were labelled with CFSE (5 uM) and co-cultured with KLK2 (+) VCap cells. KLK2×CD3 bispecific antibodies were dosed from 0 to 100 nM for 96 hours. 3:1 Effector-to-Target (ET) ratio was used. After 96 hours co-incubation, cells were harvested and stained with CD25, live/dead Dye. Flow cytometric analysis was performed on a Fortessa flow cytometer with Flowjo software. The frequencies of CTV dye dilution and activation marker CD25 were determined. The frequency of CD25 positive cells in different doses were used to graph in vitro T activation (FIG. 9A). The proliferation gate was determined using the 0 nM treatment group. The frequency of cells entering into proliferation gate was used to graph in vitro T cell proliferation (FIG. 9B). The data confirms dose dependent activation and proliferation of T cells by various KLK2×CD3 bi-specific antibodies.

In Vitro T Cell Cytokine Release by hK2×CD3 Bi-Specific Molecules.

Figure 10A:
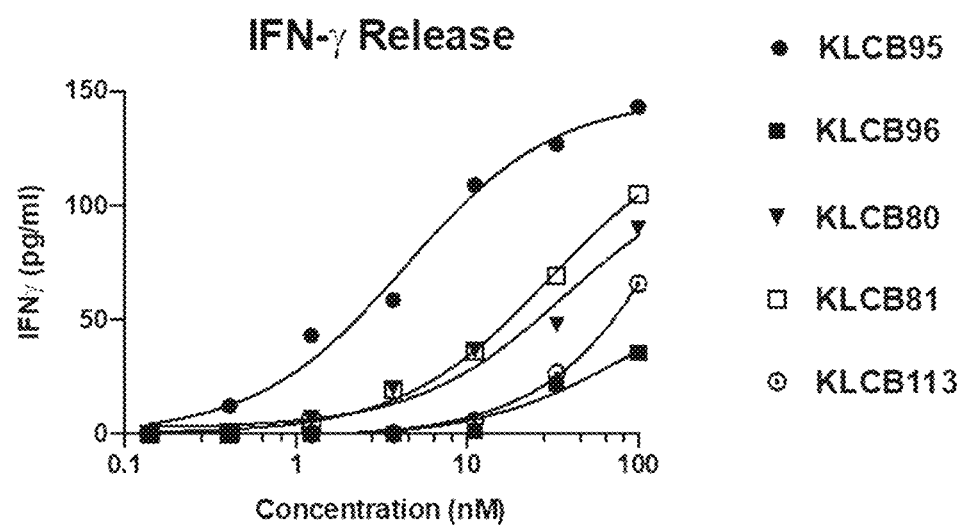
FIG. 10A shows in vitro T cell INF-γ release by KLK2× CD3 bi-specific antibodies.
Figure 10B:
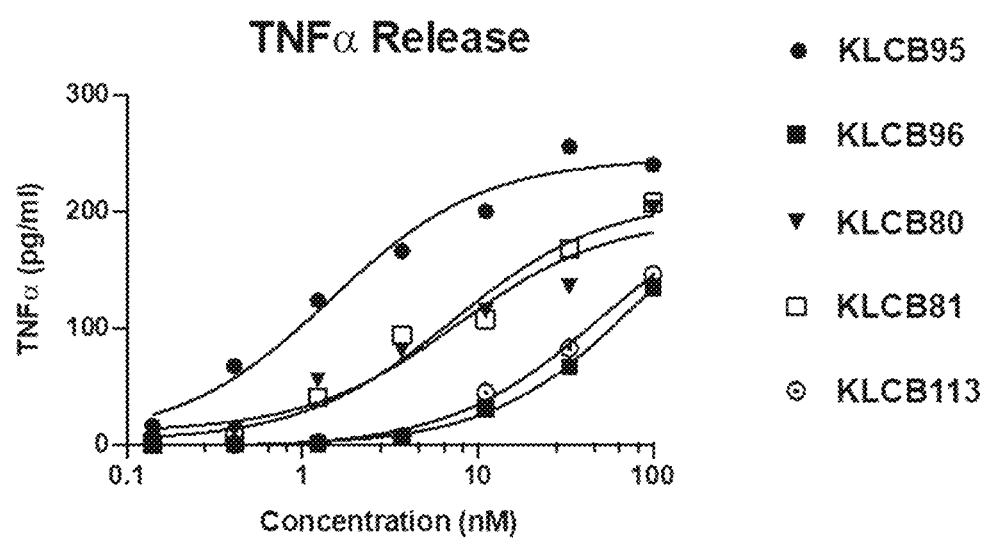
FIG. 10B shows in vitro T cell TNF-α release by KLK2× CD3 bi-specific antibodies.

The effect of anti-hK2×CD3 antibodies on T-cell cytokines release was measured in vitro. Supernatant samples were collected from the in vitro cytotoxicity experiment described above. A 13-plex cytokine Luminex assay was carried out to quantify IFN-γ and TNF-α concentrations at different doses of hK2×CD3 bispecific antibodies. FIG. 10A and FIG. 10B shows functional cytokine release by T cells activated triggered by KLK2×CD3 bi-specific antibodies in a dose-dependent manner.

Figure 39A:
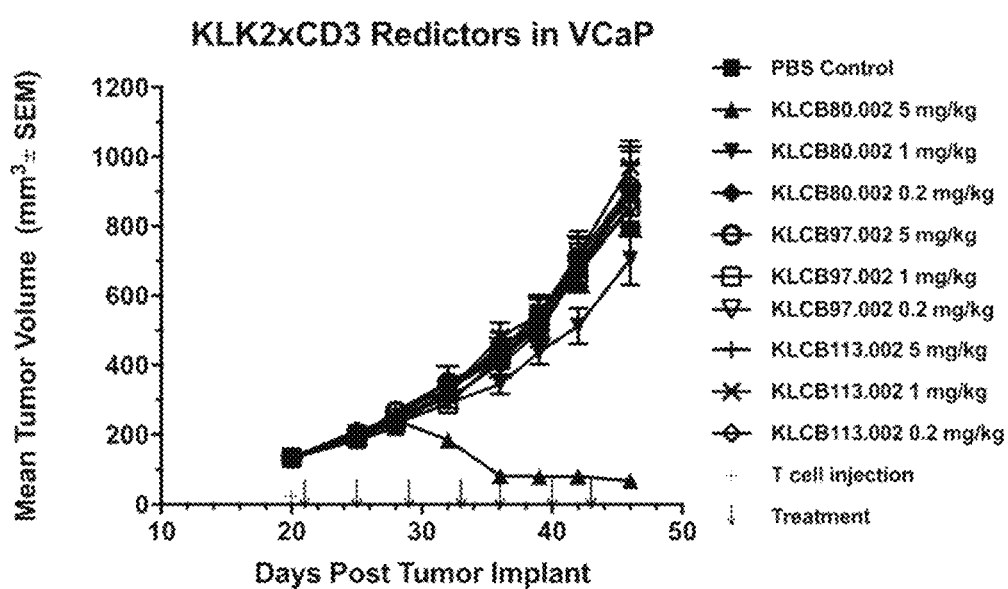
FIG. 39A shows in vivo efficacy of KLK2×CD3 bispecific antibody in VCaP xenograft mouse model and cytokine profile. Three KLK2×CD3 bispecific antibodies were tested at 3 dose levels: 5 mg/kg, 1 mg/kg, and 0.2 mg/kg. Tumor growth inhibition was plotted based on tumor volume measurement.

Efficacy of Bispecific hK2×CD3 Antibodies in Established Subcutaneous (SC) Human Prostate Xenograph Model in T Cell Humanized Mice The purpose of this study is to evaluate KLK2×CD3 bispecific in vivo efficacy in human prostate tumor VCaP s.c. mouse xenograft model. In vivo efficacy of KLK2×CD3 bispecific antibodies was evaluated in human prostate tumor VCaP s.c. mouse xenograft model. The antitumor efficacy of KLK2×CD3 molecules was evaluated in established SC human prostate VCaP xenografts. Intact male NSG mice were used to provide a suitable host for engrafting human tumors and human T cells. The human prostate cell line VCaP was obtained from American Type Culture Collection (ATCC). VCaP cells were harvested during exponential growth and mice were injected with 1-$10^7$ cells SC in a volume of 0.2 mL in the right flank. 20e6 human T cells were injected i.p for each animal. Three dose levels were evaluated with 5-fold escalation: 0.2 mg/kg, 1 mg/kg and 5 mg/kg (FIG. 39A). Bispecific antibodies were dosed twice a week via i.p. Eye blood was sampled at 6 hours post first i.p dosing and functional cytokine levels were measured using Luminex based assays (FIG. 39B). Tumor volume and body weight measurements were collected twice weekly throughout all studies. The percent delta tumor growth inhibition (ΔTGI) was defined as the difference between mean tumor burden of the treated and control groups, calculated as % ΔTGI=([(TVc−TVc0)−(TVt−TVt0)]/(TVc−TVc0))×100; where 'TVc' is the mean tumor burden of a given control group, 'TVc0' is the mean initial tumor burden of a given control group, 'TVt' is the mean tumor burden of the treated group, and 'TVt0' is the mean initial tumor burden of the treated group. % TGI was defined as ([TVc−TVt]/TVc)×100.

At least one KLK2×CD3 compound of the present invention showed dose-dependent anti-tumor effect, i.e., at 1 mg/kg. KLCB80 showed marginal tumor growth inhibition and at 5 mg/kg showed robust anti-tumor effect. Cytokine assessment at 6 hours post first dosing showed above-background functional cytokine release of the active KLCB80, which is consistent with in vivo efficacy.

Example 8: Generation and Characterization of a CAR Comprising 11B6

Figure 11:
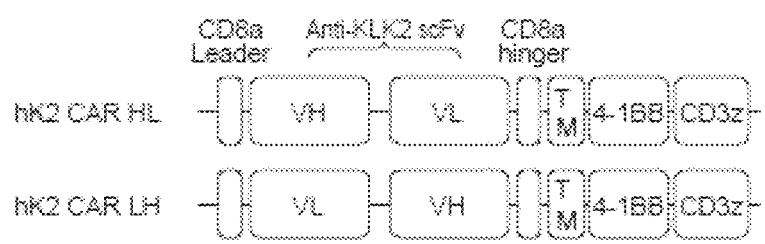
FIG. 11 show the cartoon of the design of the hK2 binding chimeric artificial receptors (CAR). The hK2 binding scFv was cloned in either VH-VL or VL-VH orientation in the various CARs.

Construction and Expression of hK2 11B6 scFv CARs hK2 CAR constructs (CAR13: HL_HCHumanized_LCHumanized_20AA and CAR15: LH_LCHumanized_HCHumanized_20AA) comprising an scFv derived from the hK2-targeting antibody 11B6 were constructed as illustrated in FIG. 11. Dynabeads Human T-Expander CD3/CD28 stimulated T cells were subjected to electroporation, then washed three times with OPTI-MEM (Invitrogen), and resuspended in OPTI-MEM at the final concentration of $50 \times 10^6$/ml. Subsequently, 0.1 ml of the cells (5E6) was mixed with 10 μg of IVT CAR encoding RNA and electroporated. Post electroporation, the T cells were transferred to a 6-well plate and immediately put back into a 37° C. incubator. Primary human T cells were electroporated with no mRNA (MOCK) or 10 μg of mRNA expressing either an hK2 scFv CAR or irrelevant control CAR. 24 hours post-electroporation CAR surface expression was measured by flow cytometry following staining with 2 μg/ml biotinylated L-protein and streptavidin-conjugated PE (FIG. 12 top panel) or biotinylated hK2 (1 μg/ml) and streptavidin-conjugated PE (FIG. 12 bottom panel).

Twenty-four hours post electroporation, the T cells were counted. 1E5 T cells were collected for each. The cells were washed with FACS buffer twice using 200 μL/well of FACS buffer for microtiter plates, with the supernatant discarded. All wells were stained with 100 μl staining buffer containing Protein L (Genscript, Cat. No. M000971:500; 2 ug/ml), incubated for at least 30 minutes at 4° C. while being protected from light. The cells were washed by adding FACS Buffer twice, using 150 μL/well for microtiter plates with FACS buffer. Centrifugation at 400×g was performed for 4 minutes at room temperature. The supernatant was then discarded. All wells were stained with 100 μl Streptavidin-R-Phycoerythrin (SA-PE; 1:250) and Live/dead Fixable Near-IR Dead Cell Stain dye (1:1000), incubated for at least 30 minutes at 4° C. while being protected from light. The cells were then ready for flow cytometry analysis.

Figure 12A:
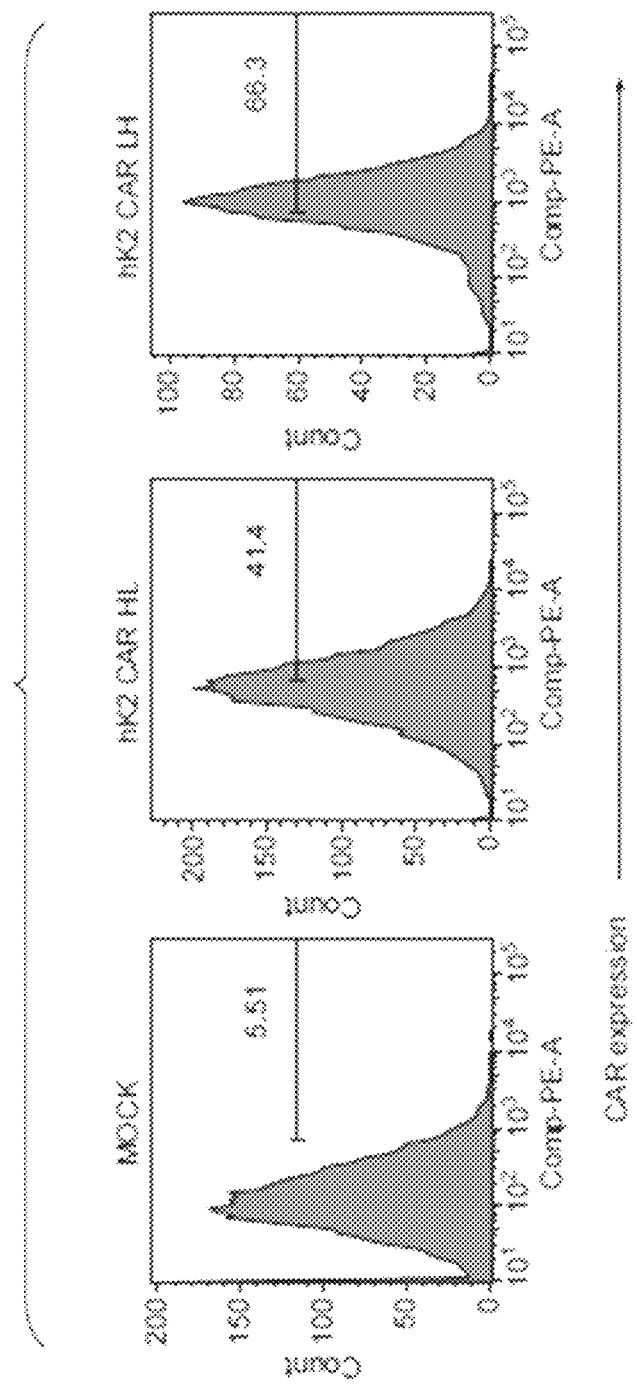
FIG. 12A and FIG. 12B show hK2 CAR expression on T cells-surface. Primary human T cells were electroporated with no mRNA (MOCK) or 10 μg of mRNA expressing either an hK2 scFv CAR or irrelevant control CAR. 24 hours post-electroporation CAR surface expression was measured by flow cytometry following staining with 2 μg/ml biotinylated L-protein and streptavidin-conjugated PE (top panel) or 2 μg/ml biotinylated L-protein and streptavidin-conjugated PE (bottom panel) or biotinylated hK2 (1 μg/ml) and streptavidin-conjugated PE.
Figure 12B:
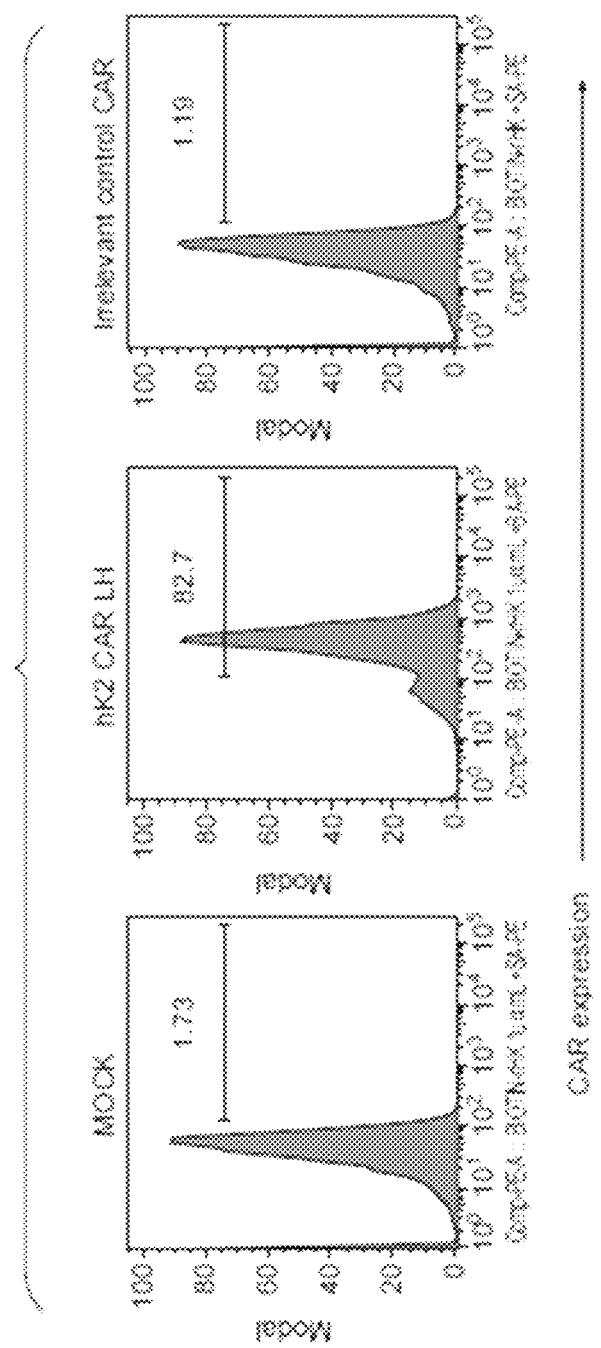

As shown in FIG. 12, top panel, protein L staining was observed on both KLK2 HL & LH CARs (41.4% and 66.3%, respectively), whereas only the background staining (~5.5%) was seen in the control T cells that were T cells without mRNA electroporation. As shown in FIG. 12, bottom panel, CAR expression on primary human T cells also could be detected via J&J internal biotin-labeled recombinant KLK2 protein (Biotin-Hk2 protein, Lot:20180810, CBIS ID:KL2W12.CB.003, 2.4 mg/ml, 1 mM Benzamidine) followed by SA-PE. As shown, T cells efficiently expressed KLK2 LH CAR (82.7%) as measured by flow cytometry, whereas only the background staining (~1.73% or 1.19%) was seen in the control T cells that were T cells without mRNA electroporation or undisclosed control CAR (non-KLK2 specific). Results are shown for representative donor T cells and were reproducible in multiple donors (at least n=3).

Table 41 shows the SEQ ID numbers of CAR13 and 15.

Tumor Cell Killing by hK2 11B6 CAR-T Cells

Co-culture for CellTrace Violet (CTV, Thermo Fisher Scientific) based cytotoxicity assay using flow cytometer was performed to study cytotoxicity of 11B6 CAR-T cells.

T cells were prepared as follows. Twenty-four hours post EP, T cells were counted and resuspended at the concentration needed for the most concentrated/desired E:T. The T cells were added at 100 μl/well of assay ($2 \times 10^6$ cells/ml; plated 100 μl in a 10:1 E:T ratio, i.e., 2E5 T cells per 2E4 target cells). A stock of the 10:1 E:T concentration was made, with two-fold serial dilutions made with complete T cell media (Optimizer w/CTS, 5% Human Serum, 1% GlutaMax) to 0.3125:1. The T cells were plated (100 ul/well) in triplicate using a 96 well round bottom tissue culture treated plate.

CTV labeled target cells were prepared as follows. 20 μL DMSO was added to a vial of CTV staining solution. This stock solution was diluted into 20 mL of PBS (warmed to 37° C.) for a 5 μM staining solution. 10E6 tumor cells were collected, washed with PBS twice and resuspended in 4E6/ml (2.5 ml). An equal volume (2.5 ml) of CTV staining solution was added. The cells were incubated for 20 minutes in a 37° C. incubator. 40 ml PRMI+20% FBS was added to the cells to absorb any unbound dye. The cells were incubated for 5 minutes. The cells were centrifuged for 5 minutes at 400×g. The cell pellet was resuspended in pre-warmed RPMI+10% FBS medium. In the meantime, T cells were seeded at the desired E/T ratio described above. The tumor cell lines Vcap (KLK2+) and DU145 (KLK2−) were recounted, and then the cells were resuspended in 2E5/ml and 100 ul in duplicate. The cells were co-incubated with labelled tumor cell lines in a flat-bottom 96-well plate.

A cytotoxicity assay was performed as follows using a flow cytometer. After 20 hours of co-culture, all of the cells were transferred to a U-bottom 96-well plate and washed. After 20 hours of co-culture all of the cells were collected from a flat-bottom 96-well plate and transferred to a U-bottom 96-well plate, and then washed. 30 μl of 0.25% trypsin was added to all the wells and incubated for 5 minutes in a 37° C. incubator. After 5 minutes, all of the tumor cells were collected to a U-bottom 96-well plate. The cells were centrifuged and washed for 5 minutes at 400×g twice. The cell pellet was then resuspended in diluted (1:1000) LIVE/DEAD™ Fixable Near-IR staining dye (100 μl). The cells were incubated for 30 mins at 4° C., and washed with FACS buffer twice by centrifuging the cells for 5 minutes at 400×g. After washing, all of the cells were fixed for 10 minutes using 100 μl of BD Cytofix™ Fixation Buffer (50 ul FACS buffer+50 ul Fixation Buffer). The cells were centrifuged and washed for 5 minutes at 400×g once. The cell pellet was resuspended in FACS buffer. Stained samples were analyzed by multicolor flow cytometry after the end of the incubation period.

The percentage of cytotoxic activity was calculated using the following equation:

% specific death=% Near IR+CTV+(dead) cells−% spontaneous Near IR+CTV+/(100%−% spontaneous Near IR+CTV+(dead) cells)×100%.

Figure 13:
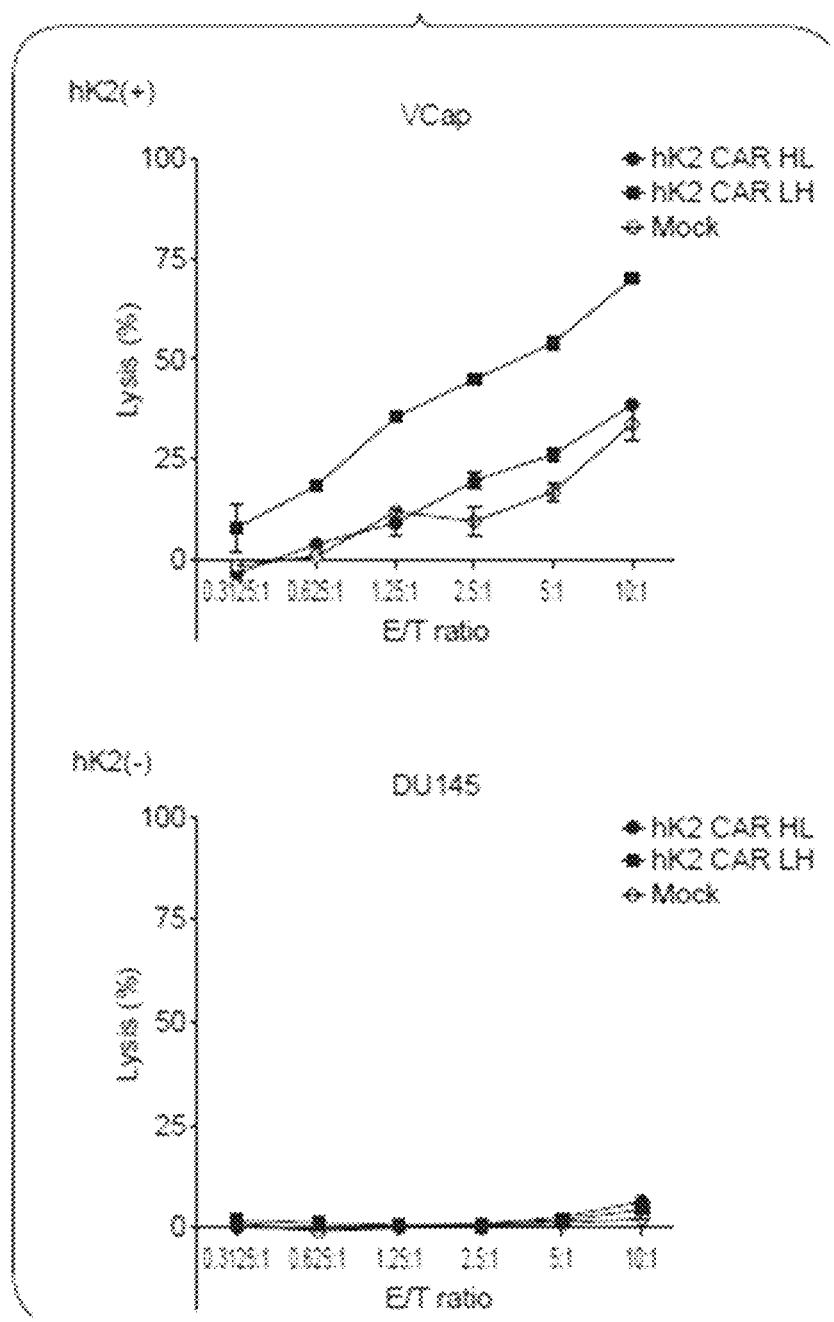
FIG. 13 shows cytotoxicity of hK2 positive (VCaP, top panel) and negative (DU145, bottom panel) tumor cells by hK2 CAR-T cells in 20-hour flow-based assay at the indicated effector-to-target cell (E/T) ratio. 24 hours after transient transfection, target cells were labeled with Cell Trace Violet (CTV) fluorescent dye and then co-cultured with hK2 CAR-T cells. Mock T cells served as negative effector controls. Percent killing was measured as the ratio of the absolute number of live (viability dye negative) target (CTV positive) cells remaining in the co-culture relative to the number of live targets cultured without CAR-T cells.

Twenty-four hours after transient transfection, target cells (hK2 positive Vcap and hK2 negative DU145 cells) were labeled with Cell Trace Violet (CTV) fluorescent dye and then co-cultured with hK2 CAR-T cells. Mock T cells served as negative effector controls. Cells were co-cultured for 20 hours at the effector-to-target cell (E/T) ratios ranging from 0.3125:1 to 10:1 as shown in FIG. 13. Percent killing was measured as the ratio of the absolute number of live (viability dye negative) target (CTV positive) cells remaining in the co-culture relative to the number of live target cells cultured without CAR-T cells. As shown, hK2 CAR LH T cells specifically and efficiently lysed the hK2(+) human prostate cancer cell lines VCap cells (FIG. 13, top panel) but not K2 (−) DU145 cells (FIG. 13, bottom panel) at E/T ratios of 10:1 to 0.3125:1, whereas only the background cytotoxicity was seen in the T cells that were Mock or hK2 HL CAR.

hK2 CAR-T cells were also tested for real-time cytotoxicity using xCELLigence as a real-time cell analysis system as a potency assay for immune cell-mediated cytolysis of target cells.

50 µL of target cancer cell culturing media was added to each well of the 96-well E-Plates (ACEA Biosciences), and the background impedance was measured and displayed as a Cell Index. Then, adherent target cells VCap and DU145 were dissociated and seeded at a density of 5E4 (VCap), 5E3 (DU145) cells/well of the E-Plate in a volume of 100 µL, and allowed to passively adhere on the electrode surface. Post seeding, the E-Plate was kept at ambient temperature inside a laminar flow hood for 30 minutes and then transferred to the RTCA MP instrument inside a cell culture incubator. Data recording was initiated immediately at 15-minute intervals for the entire duration (96 hours) of the experiment.

At the time treatment was applied (24 hours post cancer cells seeding), data acquisition was paused, 50 µL of media was removed from each well, and effector CAR-T cells were added at different effector to target (E:T) ratios in a volume of 50 µL. hK2 CAR-T and undisclosed control CAR (non-hK2 specific) T cells were resuspended. Two-fold dilutions were then performed in duplicate in a 96-well plate (from 5:1 to 0.156:1 E/T ratio). Target plus Mock effector controls (no RNA electroporation T cells) were also added to the target cells.

Figure 14:
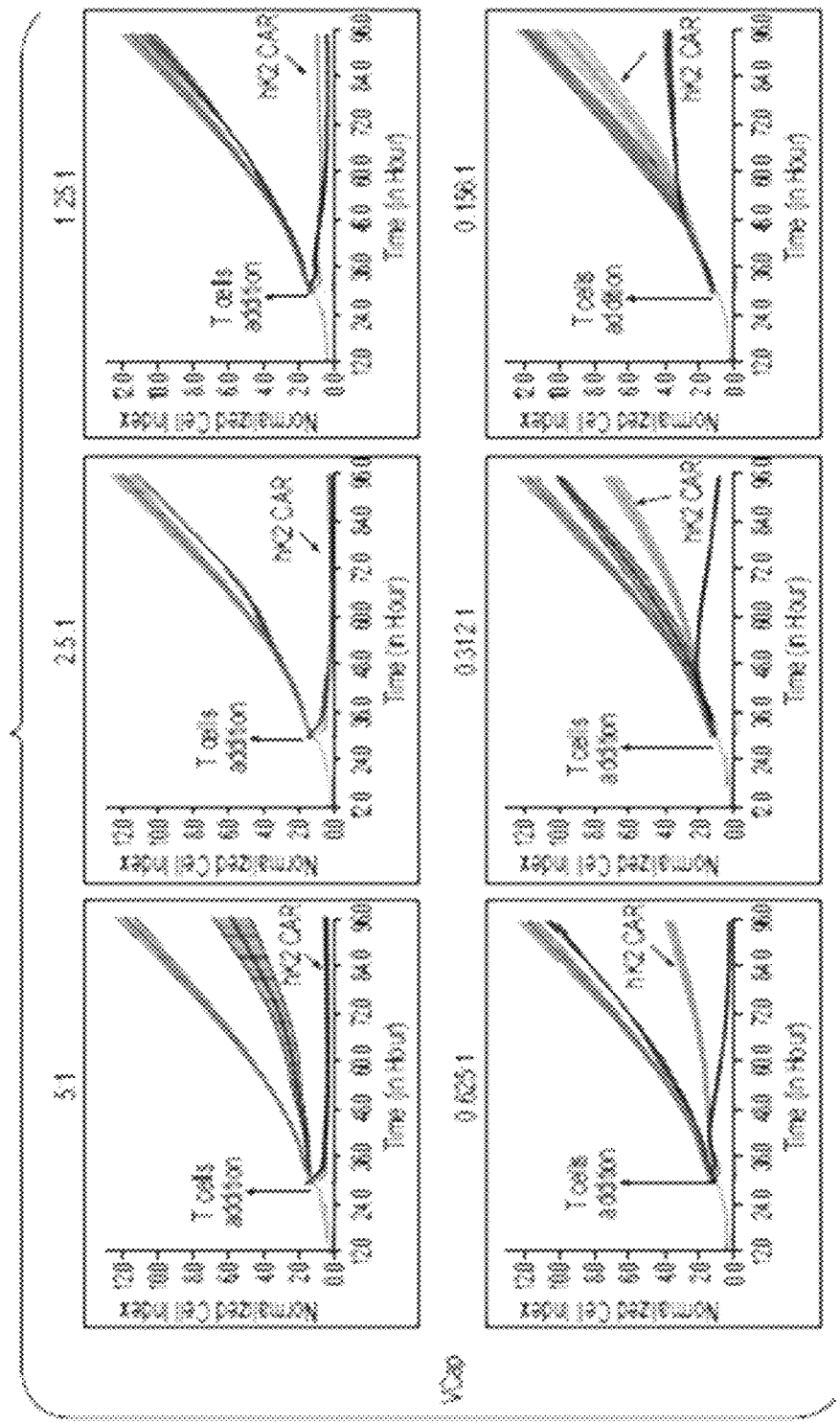
FIG. 14 shows real-time hK2 CAR-T cell-mediated cytotoxicity. Normalized cell index (CI) plot for VCaP target cells (5E4) incubated with Mock, 10 µg mRNA electroporated (24 hours post transfection) hK2 11B6 CAR LH or control CAR-T cells at different E:T ratios for approximately 72 hours. When seeded alone, target cells adhered to the plate and proliferated, increasing the CI readout. When T cells were added to target cells, hK2 CAR and control CAR-T cells mediated hK2 positive VCaP cell cytolysis and subsequent progressive decrease in CI at an E/T ratio from 5:1 to 0.156:1. The reduction in CI value after addition of effector cells reflected the loss of viability of target cells. The Y-axis shows the normalized CI generated by the RTCA software and displayed in real time. X-axis is the time of cell culture and treatment time in hour. Mean values of the CI were plotted standard deviation.
Figure 15:
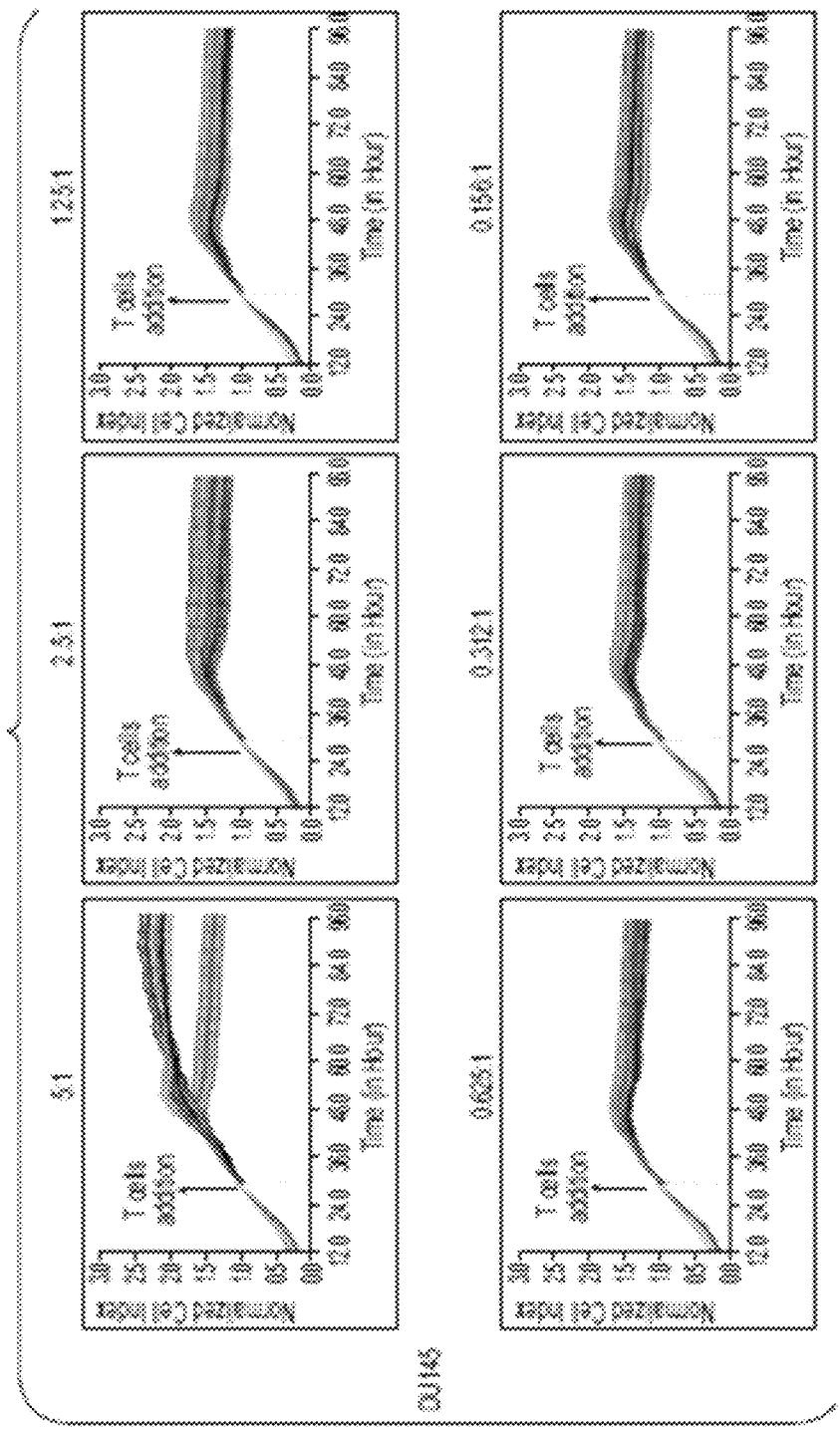
FIG. 15 shows lack of real-time hK2 CAR-T cell-mediated cytotoxicity of target cells not expressing hK2. Normalized cell index (CI) plot for DU145 target cells (5E3) incubated with Mock, 10 µg mRNA electroporated (24 hours post transfection) hK2 11B6 CAR LH or control CAR-T cells at different E:T ratios for approximately 72 hours. When seeded alone, target cells adhered to the plate and proliferated, increasing the CI readout. When T cells were added to target cells, hK2 CAR-T and control CAR-T cells did not reduce CI after addition which displayed no cytolytic activity. The Y-axis shows the normalized CI generated by the RTCA software and displayed in real time. X-axis is the time of cell culture and treatment time in hour. Mean values of the CI were plotted standard deviation.

Target cells VCap (5E4) and DU145 (5E3) incubated with Mock, 10 µg mRNA electroporated (24 hours post transfection) hK2 11B6 CAR LH or control CAR-T cells at different E/T ratios for approximately 72 hours. Normalized cell index (CI) plots for VCap and DU145 are shown in FIG. 14 and FIG. 15, respectively. When seeded alone, target cells adhered to the plate and proliferated, increasing the CI readout. When T cells were added to target cells, hK2 CAR and control CAR-T cells mediated hK2 (+) VCap cell cytolysis and subsequent progressive decrease in CI at an E/T ratio from 5:1 to 0.156:1.

Cytokine Production by hK2 11B6 CAR-T Cells

IFN-γ produced by cytotoxic T cells allows for exertion of immune surveillance of tumors, which can directly inhibit proliferation and induce apoptosis of some malignancies in vivo and in vitro. To determine whether hK2 CAR-T cells were able to recognize and be activated by hK2 (+) tumor cells, the supernatant was collected from xCELLigence-based killing assay, as described in Example 3. After about 70 hours co-culture, the supernatant was collected and assayed by ELISA according to the directions provided with the ELISA kit (Human IFN-γ ELISA MAX™ Deluxe, BioLegend, Cat #:430106).

Figure 16:
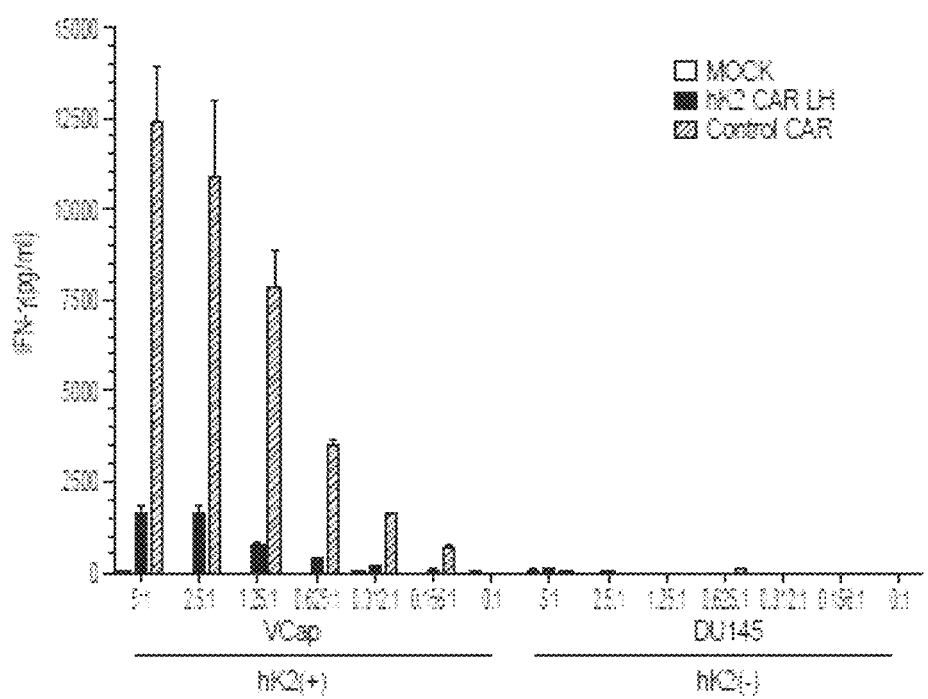
FIG. 16 shows interferon-γ (IFN-γ) production by antigen-stimulated hK2 CAR-T cells. Supernatant was collected from xCELLigence based killing assay approximately 70 hours co-culture (VCap #5E4, DU145 #5E3). hK2 CAR_LH and Control CAR modified T cells secreted IFN-γ during co-culture with hK2-expressing VCaP cells, but not with hK2-negative DU145 cells. Mean IFN-γ concentration±standard deviation (pg/ml) from duplicate cultures is shown.

IFN-γ production of antigen-stimulated CAR-T cells is shown in FIG. 16. hK2 CAR LH and control CAR-T cells secreted IFN-γ during co-culture with hK2-expressing VCap cells in a E:T ratio-dependent manner, but not during co-culture with hK2-negative DU145 cells. Undisclosed control CAR secreted much higher amount of IFN-γ due to the much higher antigen expression level than hK2. Mean IFN-γ concentration ±SD (pg/ml) from duplicate cultures was recorded.

Example 9: Generation and Characterization of Additional scFvs CAR Constructs

As described in Example 1, the ectodomain of 11B6 cloned as scFv did not retain binding at elevated temperature (55° C.) and hence additional campaigns were initiated to generate new humanized antibodies from the parental 11B6.

hK2 CARs containing thermally stabilized scFvs derived from the antibody 11B6 were generated (CAR1-CAR12, CAR14, CAR16). The description and SEQ ID NOs: of the CAR constructs containing thermally stabilized scFvs are provided in Table 13. The names in the description (HCG5, LCD6, HCF3, LCB7) refer back to the VH or the VL chains identified in Example 1, 20AA refers to the 20 amino acid long linker between the VH/VL pairs in the scFv. The scFv in the CARs were cloned in either VH-L-VL or VL-L-VH orientation.

The generated scFvs also incorporated into CAR constructs (CAR17-CAR36) and further characterized. Table 41 shows the generated CAR constructs and their SEQ ID NOs. The signal sequence used is MAWVWTLLFLMAAAQ-SIQA (SEQ ID NO: 24)

TABLE 41

| Name of CAR construct | Description of scFv in the CAR | SEQ ID NO: of scFv amino acid sequence of the CAR | SEQ ID NO: of full ECD domain of CAR (including signal sequence) | SEQ ID NO: of CAR amino acid sequence |
|---|---|---|---|---|
| CAR1 | HL_HCG5_LCD6_20AA (scFv1) | 8 | 29 | 46 |
| CAR2 | HL_HCG5_LCHumanized_20AA (scFv2) | 9 | 30 | 47 |
| CAR3 | HL_HCF3_LCB7_20AA (scFv3) | 10 | 31 | 48 |
| CAR4 | HL_HCG5_LCB7_20AA (scFv4) | 11 | 32 | 49 |
| CAR5 | LH_LCD6_HCG5_20AA (scFv5) | 12 | 33 | 50 |
| CAR6 | LH_LCHumanized_HCF3_20AA (scFv6) | 13 | 34 | 51 |
| CAR7 | LH_LCHumanized_HCG5_20AA (scFv7) | 14 | 35 | 52 |
| CAR8 | LH_LCB7_HCF3_20AA (scFv8) | 15 | 36 | 53 |

TABLE 41-continued

| Name of CAR construct | Description of scFv in the CAR | SEQ ID NO: of scFv amino acid sequence of the CAR | SEQ ID NO: of full ECD domain of CAR (including signal sequence) | SEQ ID NO: of CAR amino acid sequence |
|---|---|---|---|---|
| CAR9 | LH__LCB7__HCG5__20AA (scFv9) | 16 | 37 | 54 |
| CAR10 | LH__LCD6__HCF3__20AA (scFv10) | 17 | 38 | 55 |
| CAR11 | HL__HCHumanized__LCB7__20AA (scFv11) | 18 | 39 | 56 |
| CAR12 | HL__HCHumanized__LCD6__20AA (scFv12) | 19 | 40 | 57 |
| CAR13 | HL__HCHumanized__LCHumanized__20AA (scFv13) | 20 | 41 | 58 |
| CAR14 | LH__LCD6__HCHumanized__20AA (scFv14) | 21 | 42 | 59 |
| CAR15 | LH__LCHumanized__HCHumanized__20AA (scFv15) | 22 | 43 | 60 |
| CAR16 | LH__LCB7__HCHumanized__20AA (scFv16) | 23 | 44 | 61 |
| CAR17 | KL2B413__HL (scFv17) | 133 | 149 | 153 |
| CAR18 | KL2B413__LH (scFv18) | 134 | 150 | 154 |
| CAR19 | KL2B359__HL (scFv19) | 135 | 151 | 155 |
| CAR20 | KL2B359__LH (scFv20) | 136 | 152 | 156 |
| CAR21 | KL2B357__HL | 318 | 410 | 426 |
| CAR22 | KL2B357__LH | 319 | 411 | 427 |
| CAR23 | KL2B358__HL | 320 | 412 | 428 |
| CAR24 | KL2B358__LH | 321 | 413 | 429 |
| CAR25 | KL2B360__HL | 322 | 414 | 430 |
| CAR26 | KL2B360__LH | 323 | 415 | 431 |
| CAR27 | KL2B30__HL | 404 | 416 | 432 |
| CAR28 | KL2B30__LH | 405 | 417 | 433 |
| CAR29 | KL2B53__HL | 406 | 418 | 434 |
| CAR30 | KL2B53__LH | 407 | 419 | 435 |
| CAR31 | KL2B242__HL | 408 | 420 | 436 |
| CAR32 | KL2B242__LH | 409 | 421 | 437 |
| CAR33 | KL2B467__HL | 324 | 422 | 438 |
| CAR34 | KL2B467__LH | 325 | 423 | 439 |
| CAR35 | KL2B494__HL | 308 | 424 | 440 |
| CAR36 | KL2B494__LH | 316 | 425 | 441 |

LCHumanized refers to hu11B6__VL.
HCHumanized refers to hu11B6__VH

The scFv amino acid sequences of the CARs are shown in table 13 of Example 2.

The CARs full-length ECD domain and full-length amino acid sequences are listed below.

```
Extracellular antigen-binding domain 1 (HL_HCG5_LCD6_20AA)
                                                          SEQ ID NO: 29
MAWVWTLLFLMAAAQSIQAQVQLQESGPGLVKPSDTLSLTCAVSGNSITSDYAWNWIRQFPGK

GLEWMGYISYSGSTTYNPSLKSRVTISRDTSKNQFSLKLSSVTPVDTAVYYCATGYYYGSGFWG

QGTLVTVSSGGSEGKSSGSGSESKSTGGSDIVLTQSPDSLAVSLGERATINCKASESVEYFGTSLM

HWYQQKPQPPKLLIYAASNRESGVPDRFSGSGSGTDFTLTIQSVQAEDVSVYFCQQTRKVPYTF

GQGTKLEIK

Extracellular antigen-binding domain 2 (HL_HCG5_LCHumanized_20AA)
                                                          SEQ ID NO: 30
MAWVWTLLFLMAAAQSIQAQVQLQESGPGLVKPSDTLSLTCAVSGNSITSDYAWNWIRQFPGK

GLEWMGYISYSGSTTYNPSLKSRVTISRDTSKNQFSLKLSSVTPVDTAVYYCATGYYYGSGFWG

QGTLVTVSSGGSEGKSSGSGSESKSTGGSDIVLTQSPDSLAVSLGERATINCKASESVEYFGTSLM

HWYQQKPGQPPKLLIYAASNRESGVPDRFSGSGSGTDFTLTISSLQAEDVAVYYCQQTRKVPYTF

GQGTKLEIK

Extracellular antigen-binding domain 3 (HL_HCF3_LCB7_20AA)
                                                          SEQ ID NO: 31
MAWVWTLLFLMAAAQSIQAQVQLQESGPGLVKPSDTLSLTCAVSGNSITSDYAWNWIRQFPGK

GLEWIGYISYSGSTTYNPSLKSRVTISRDTSKNQFSLKLSSVTPVDTAVYYCATGYYYGSGFWGQ

GTLVTVSSGGSEGKSSGSGSESKSTGGSDIVLTQSPDSLAVSLGERATINCKASESVEYFGTSLMH

WYQQKPGQPPKLLIYAASNRESGVPDRFSGSGSGTDFTLTISSVQAEDVAVYYCQQTRKVPYTF

GQGTKLEIK
```

-continued

Extracellular antigen-binding domain 4 (HL_HCG5_LCB7_20AA)
SEQ ID NO: 32
MAWVWTLLFLMAAAQSIQAQVQLQESGPGLVKPSDTLSLTCAVSGNSITSDYAWNWIRQFPGK
GLEWMGYISYSGSTTYNPSLKSRVTISRDTSKNQFSLKLSSVTPVDTAVYYCATGYYYGSFWG
QGTLVTVSSGGSEGKSSGSGSESKSTGGSDIVLTQSPDSLAVSLGERATINCKASESVEYFGTSLM
HWYQQKPGQPPKLLIYAASNRESGVPDRFSGSGSGTDFTLTISSVQAEDVAVYYCQQTRKVPYT
FGQGTKLEIK Extracellular antigen-binding domain 5 (LH_LCD6_HCG5_20AA)
SEQ ID NO: 33
MAWVWTLLFLMAAAQSIQADIVLTQSPDSLAVSLGERATINCKASESVEYFGTSLMHWYQQKP
GQPPKLLIYAASNRESGVPDRFSGSGSGTDFTLTIQSVQAEDVSVYFCQQTRKVPYTFGQGTKLEI
KGGSEGKSSGSGSESKSTGGSQVQLQESGPGLVKPSDTLSLTCAVSGNSITSDYAWNWIRQFPGK
GLEWMGYISYSGSTTYNPSLKSRVTISRDTSKNQFSLKLSSVTPVDTAVYYCATGYYYGSFWG
QGTLVTVSS Extracellular antigen-binding domain 6 (LH_LCHumanized_HCF3_20AA)
SEQ ID NO: 34
MAWVWTLLFLMAAAQSIQADIVLTQSPDSLAVSLGERATINCKASESVEYFGTSLMHWYQQKP
GQPPKLLIYAASNRESGVPDRFSGSGSGTDFTLTISSLQAEDVAVYYCQQTRKVPYTFGQGTKLEI
KGGSEGKSSGSGSESKSTGGSQVQLQESGPGLVKPSDTLSLTCAVSGNSITSDYAWNWIRQFPGK
GLEWIGYISYSGSTTYNPSLKSRVTISRDTSKNQFSLKLSSVTPVDTAVYYCATGYYYGSFWGQ
GTLVTVSS Extracellular antigen-binding domain 7 (LH_LCHumanized_HCG5_20AA)
SEQ ID NO: 35
MAWVWTLLFLMAAAQSIQADIVLTQSPDSLAVSLGERATINCKASESVEYFGTSLMHWYQQKP
GQPPKLLIYAASNRESGVPDRFSGSGSGTDFTLTISSLQAEDVAVYYCQQTRKVPYTFGQGTKLEI
KGGSEGKSSGSGSESKSTGGSQVQLQESGPGLVKPSDTLSLTCAVSGNSITSDYAWNWIRQFPGK
GLEWMGYISYSGSTTYNPSLKSRVTISRDTSKNQFSLKLSSVTPVDTAVYYCATGYYYGSFWG
QGTLVTVSS Extracellular antigen-binding domain 8 (LH_LCB7_HCF3_20AA)
SEQ ID NO: 36
MAWVWTLLFLMAAAQSIQADIVLTQSPDSLAVSLGERATINCKASESVEYFGTSLMHWYQQKP
GQPPKLLIYAASNRESGVPDRFSGSGSGTDFTLTISSVQAEDVAVYYCQQTRKVPYTFGQGTKLEI
KGGSEGKSSGSGSESKSTGGSQVQLQESGPGLVKPSDTLSLTCAVSGNSITSDYAWNWIRQFPGK
GLEWIGYISYSGSTTYNPSLKSRVTISRDTSKNQFSLKLSSVTPVDTAVYYCATGYYYGSFWGQ
GTLVTVSS Extracellular antigen-binding domain 9 (LH_LCB7_HCG5_20AA)
SEQ ID NO: 37
MAWVWTLLFLMAAAQSIQADIVLTQSPDSLAVSLGETINCKASESVEYFGTSLMHWYQQKP
GQPPKLLIYAASNRESGVPDRFSGSGSGTDFTLTISSVQAEDVAVYYCQQTRKVPYTFGQGTKLEI
KGGSEGKSSGSGSESKSTGGSQVQLQESGPGLVKPSDTLSLTCAVSGNSITSDYAWNWIRQFPGK
GLEWMGYIISYSGSTTYNPSLKSRVTISRDTSKNQFSLKLSSVTPVDTAVYYCATGYYYGSFWG
QGTLVTVSS Extracellular antigen-binding domain 10 (LH_LCD6_HCF3_20AA)
SEQ ID NO: 38
MAWVWTLLFLMAAAQSIQADIVLTQSPDSLAVSLGERATINCKASESVEYFGTSLMHWYQQKP
GQPPKLLIYAASNRESGVPDRFSGSGSGTDFTLTIQSVQAEDVSVYFCQQTRKVPYTFGQGTKLEI
KGGSEGKSSGSGSESKSTGGSQVQLQESGPGLVKPSDTLSLTCAVSGNSITSDYAWNWIRQFPGK

```
GLEWIGYISYSGSTTYNPSLKSRVTISRDTSKNQFSLKLSSVTPVDTAVYYCATGYYYGSGFWGQ

GILVTVSS

Extracellular antigen-binding domain 11 (HL_HCHumanized_LCB7_20AA)
                                                        SEQ ID NO: 39
MAWVWTLLFLMAAAQSIQAQVQLQESGPGLVKPSDTLSLTCAVSGNSITSDYAWNWIRQPPGK

GLEWIGYISYSGSTTYNPSLKSRVTMSRDTSKNQFSLKESSVTAVDTAVYYCATGYYYGSGFWG

QGTLVTVSSGGSEGKSSGSGSESKSTGGSDIVLTQSPDSLAVSLGERATINCKASESVEYFGTSLM

HWYQQKPGQPPKLLIYAASNRESGVPDRFSGSGSGTDFTLTISSVQAEDVAVYYCQQTRKVPYT

FGQGTKLEIK

Extracellular antigen-binding domain 12 (HL_HCHumanized_LCD6_20AA)
                                                        SEQ ID NO: 40
MAWVWTLLFLMAAAQSIQAQVQLQESGPGLVKPSDTLSLTCAVSGNSITSDYAWNWIRQPPGK

GLEWIGYISYSGSTTYNPSLKSRVTMSRDTSKNQFSLKLSSVTAVDTAYYCATGYYYGSGFWG

QGTLVTVSSGGSEGKSSGSGSESKSTGGSDIVLTQSPDSLAVSLGERATINCKASESVEYFGTSLM

HWYQQKPGQPPKLLIYAASNRESGVPDRFSGSGSGTDFTLTIQSVQAEDVSVYFCQQTRKVPYTF

GQGTKLEIK

Extracellular antigen-binding domain 13 (HL_HCHumanized_LCHumanized_20AA)
                                                        SEQ ID NO: 41
MAWVWTLLFLMAAAQSIQAQVQLQESGPGLVKPSDTLSLTCAVSGNSITSDYAWNWIRQPPGK

GLEWIGYISYSGSTTYNPSLKSRVTMSRDTSKNQFSLKLSSVTAVDTAVYYCATGYYYGSGFWG

QGTLVTVSSGGSEGKSSGSGSESKSTGGSDIVLTQSPDSLAVSLGERATINCKASESVEYFGTSLM

HWYQQKPQPPKLLIYAASNRESGVPDRFSGSGSGTDFTLTISSLQAEDVAVYYCQQTRKVPYTF

GQGTKLEIK

Extracellular antigen-binding domain 14 (LH_LCD6_HCHumanized_20AA)
                                                        SEQ ID NO: 42
MAWVWTLLFLMAAAQSIQADIVLTQSPDSLAVSLGERATINCKASESVEYFGTSLMHWYQQKP

GQPPKLLIYAASNRESGVPDRFSGSGSGTDFTLTIQSVQAEDVSVYFCQQTRKVPYTFGQGTKLEI

KGGSEGKSSGSGSESKSTGGSQVQLQESGPGLVKPSDTLSLTCAVSGNSITSDYAWNWIRQPPGK

GLEWIGYISYSGSTTYNPSLKSRVTMSRDTSKNQFSLKLSSVTAVDTAVYYCATGYYYGSGFWG

QGTLVTVSS

Extracellular antigen-binding domain 15 (LH_LCHumanized_HCHumanized_20AA)
                                                        SEQ ID NO: 43
MAWVWTLLFLMAAAQSIQADIVLTQSPDSLAVSLGERATINCKASESVEYFGTSLMHWYQQKP

GQPPKLLIYAASNRESGVPDRFSGSGSGTDFTLTISSLQAEDVAVYYCQQTRKVPYTFGQGTKLEI

KGGSEGKSSGSGSESKSTGGSQVQLQESGPGLNKPSDTLSLTCAVSGNSITSDYAWNWIRQPPGK

GLEWIGYISYSGSTTYNPSLKSRVTMSRDTSKNQFSLKLSSVTAVDTAVYYCATGYYYGSGFWG

QGTLVTVSS

Extracellular antigen-binding domain 16 (LH_LCB7_HCHumanized_20AA)
                                                        SEQ ID NO: 44
MAWVWTLLFLMAAAQSIQADIVLTQSPDSLAVSLGERATINCKASESVEYFGTSLMHWYQQKP

GQPPKLLIYAASNRESGVPDRFSGSGSGTDFTLTISSVQAEDVAVYYCQQTRKVPYTFGQGTKLEI

KGGSEGKSSGSGSESKSTGGSQVQLQESGPGLVKPSDTLSLTCAVSGNSITSDYAWNWIRQPPGK

GLEWIGYISYSGSTTYNPSLKSRVTMSRDTSKNQFSLKLSSVTAVDTAVYYCATGYYYGSGFWG

QGTLVTVSS (KL2B413_HL)
                                                        SEQ ID NO: 149
MAWVWTLLFLMAAAQSIQAEVQLVESGGGLVQPGGSLRLSCAASGFTFSSYWMTWVRQAPGK

GLEWVANIKQDGSERYYVDSVKGRFTISRDNAKNSLYLQMNSLRAEDTAVYYCARDQNYDILT
```

```
GHYGMDVWGQGTTVTVSSGGSEGKSSGSGSESKSTGGSEIVLTQSPSFLSASVGDRVTITCRASQ

GISSYLSWYQQKPGKAPKLLIYATSTLQSGVPSRFSGSGSGTEFTLTISSLQPEDFATYYCQQLNSY

PRTFGQGTKVEIK (KL2B413_LH)
                                                    SEQ ID NO: 150
MAWVWTLLFLMAAAQSIQAEVLTQSPSFLSASVGDRVTITCRASQGISSYLSWYQQKPGKAPK

LLIYATSTLQSGVPSRFSGSGSGTEFTLTISSLQPEDFATYYCQQLNSYPRTFGQGTKVEIKGGSEG

KSSGSGSESKSTGGSEVQLVESGGGLVQPGGSLRLSCAASGFTFSSYWMTWVRQAPGKGLEWV

ANIKQDGSERYYVDSVKGRFTISRDNAKNSLYLQMNSLRAEDTAVYYCARDQNYDILTGHYGM

DVWGQGTTVTVSS (KL2B359_HL)
                                                    SEQ ID NO: 151
MAWVWTLLFLMAAAQSIQAVQLQESGPGLVKPSQTLSLTCTVSGNSITSDYAWNWIRQFPGK

RLEWIGYISYSGSTTYNPSLKSRVTISRDTSKNQFSLKLSSVTAADTAVYYCATGYYYGSGFWGQ

GTLVTVSSGGSEGKSSGSGSESKSTGGSEIVLTQSPATLSLSPGERATLSCRASESVEYFGTSLMH

WYQQKPGQPPRLLIYAASNVESGIPARFSGSGSGMFTLTISSVEPEDFAVYFCQQTRKVPYTFGG

GTKVEIK (KL2B359_LH)
                                                    SEQ ID NO: 152
MAWVWTLLFLMAAAQSIQAEIVLTQSPATLSLSPGERATLSCRASESVEYFGTSLMHWYQQKPG

QPPRLLIYAASNVESGIPARFSGSGSGTDFTLTISSVEPEDFAVYFCQQTRKVPYTFGGGTKVEIKG

GSEGKSSGSGSESKSTGGSQVQLQESGPGLVKPSQTLSLTCTVSGNSITSDYAWNWIRQFPGKRL

EWIGYISYSGSTTYNPSLKSRVTISRDTSKNQFSLKLSSVTAADTAVYYCATGYYYGSGFWGQGT

LVTVSS (KL2B357_HL)
                                                    SEQ ID NO: 410
MAWVWTLLFLMAAAQSIQAVQLQESGPGLVKPSQTLSLTCTVSGNSITSDYAWNWIRQFPGK

GLEWIGYISYSGSTTYNPSLKSRVTISRDTSKNQFSLKLSSVTAADTAVYYCATGYYYGSGFWGQ

GTLVTVSSGGSEGKSSGSGSESKSTGGSDIVLTQSPDSLAVSLGERATINCRASESVEYFGTSLMH

WYQQKPGQPPKWYAASNVESGVPDRFSGSGSGTDFTLTISSLQAEDVAVYFCQQTRKVPYTFG

GGTKVEIK (KL2B357_LH)
                                                    SEQ ID NO: 411
MAWVWTLLFLMAAAQSIQADIVLTQSPDSLAVSLGERATINCRASESVEYFGTSLMHWYQQKP

GQPPKLLIYAASNVESGVPDRFSGSGSGTDFTLTISSLQAEDVAVYFCQQTRKVPYTFGGGTKVEI

KGGSEGKSSGSGSESKSTGGSQVQLQESGPGLVKPSQTLSLTCTVSGNSITSDYAWNWIRQFPGK

GLEWIGYISYSGSTTYNPSLKSRVTISRDTSKNQFSLKLSSVTAADTAVYYCATGYYYGSGFWGQ

GTLVTVSS (KL2B358_HL)
                                                    SEQ ID NO: 412
MAWVWTLLFLMAAAQSIQAVQLQESGPGLNKPSQTLSLTCTVSGNSITSDYAWNWIRQPPGK

GLEWIGYISYSGSTTYNPSLKSRVTISRDTSKNQFSLKLSSVTAADTAVYYCATGYYYGSGFWGQ

GTLVTVSSGGSEGKSSGSGSESKSTGGSEIVLTQSPATLSLSPGERATLSCRASESVEYFGTSLMH

WYQQKPGQPPRLLIYAASNVESGIPARFSGSGSGTDFTLTISSVEPEDFAVYFCQQTRKVPYTFGG

GTKVEIK
```

(KL2B358_LH)

SEQ ID NO: 413

MAWVWTLLFLMAAAQSIQAEIVLTQSPATLSLSPGERATLSCRASESVEYFGTSLMHWYQQKPG
QPPRLLIYAASNVESGIPARFSGSGSTDFTLTISSVEPEDFAVYFCQQTRKVPYTFGGGTKVEIKG
GSEGKSSGSGSESKSTGGSQVQLQESGPGLVKPSQTLSLTCTVSGNSITSDYAWNWIRQPPGKGL
EWIGYISYSGSTTYNPSLKSRVTISRDTSKNQFSLKLSSVTAADTAVYYCATGYYYGSGFWGQGT
LVTVSS (KL2B360_HL)

SEQ ID NO: 414

MAWVWTLLFLMAAAQSIQAQVQLQESGPGLVKPSQTLSLTCTVSGNSITSDYAWNWIRQFPGK
GLEWIGYISYSGSTTYNPSLKSRVTISRDTSKNQFSLKLSSVTAADTAVYYCATGYYYGSGFWGQ
GTLVTVSSGGSEGKSSGSGSESKSTGGSEIVLTQSPATLSLSPGERATLSCRASESVEYFGTSLMH
WYQQKPGQPPRLLIYAASNVESGIPARFSGSGSTDFTLTISSVEPEDFAVYFCQQTRKVPYTFGG
GTKVEIK (KL2B360_LH)

SEQ ID NO: 415

MAWVWTLLFLMAAAQSIQAEIVILTQSPATLSLSPGERATLSCRASESVEYFGTSLATHWYQQKPG
QPPRLLIYAASNVESGIPARFSGSGSTDFTLTISSVEPEDFAVYFCQQTRKVPYTFGGGTKVEIKG
GSEGKSSGSGSESKSTGGSQVQLQESGPGLVKPSQTLSLTCTVSGNSITSDYAWNWIRQFPGKGL
EWIGYISYSGSTTYNPSLKSRVTISRDTSKNQFSLKLSSVTAADTAVYYCATGYYYGSGFWGQGT
LVTVSS (KL2B30_HL)

SEQ ID NO: 416

MAWVWTLLFLMAAAQSIQAQVQLQESGPGLVKPSETLSLTCTVSGGSISSYYWSWIRQPPGKGL
EWIGYIYYSGSTNYNPSLKSRVTISVDTSKNQFSLKLSSVTAADTAVYYCAGTTIFGVVTPNFYY
GMDVWGQGTTVTVSSGGSEGKSSGSGSESKSTGGSDIQMTQSPSFLSASVGDRVTITCRASQGIS
SYLAWYQQKPGKAPKFLIYAASTLQSGVPSRFSGSGSGTEFTLTISSLQPEDFATYYCQQLNSYPL
TFGGGTKVEIK (KL2B30_LH)

SEQ ID NO: 417

MAWVWTLLFLMAAAQSIQADIQMTQSPSFLSASVGDRVTITCRASQGISSYLAWYQQKPGKAPK
FLIYAASTDSGVPSRFSGSGSGTEFTLTISSLQPEDFATYYCQQLNSYPLTFGGGTKVEIKGGSEG
KSSGSGSESKSTGGSQVQLQESGPGLVKPSETLSLTCTVSGGSISSYYWSWIRQPPGKGLEWIGYI
YYSGSTNYNPSLKSRVTISVDTSKNQFSLKLSSVTAADTAVYYCAGTTIFGVVTPNFYYGMDVW
GQGTTVTVSS (KL2B53_HL)

SEQ ID NO: 418

MAWVWTLLFLMAAAQSIQAEVQLVESGGGVVQPGRSLRLSCVASGFTFSSYDIHWVRQAPGKG
LEWVAIISYDGSKKDYTDSVKGRFTISRDNSKNTLYLQMDSLRVEDSAVYSCARESGWSHYYYY
GMDVWGQGTMVTVSSGGSEGKSSGSGSESKSTGGSDIVMTQSPSSLSASVGDPSTITCRASQDIS
NYLAWYQQKPGKVPKFLIYAASTLHSGVPSRFSGSGSGTDFTLTISSLQPEDVATYYCQKYNSAP
YTFGQGTRLEIK (KL2B53_LH)

SEQ ID NO: 419

MAWVWFLLFLMAAAQSIQADIVMTQSPSSLSASVGDRVTITCRASQDISNYLAWYQQKPGKVP
KFLIYAASTLHSGVPSRFSGSGSGTDFTLTISSLQPEDVATYYCQKYNSAPYTFGQGTRLEIKGGS
EGKSSGSGSESKSTGGSEVQINESGGGVVQPGRSLRLSCVASGFTFSSYDIHWIVRQAPGKGLEW

-continued

VAIISYDGSKKDYTDSVKGRFTISRDNSKNTLYLQMDSLRVEDSAVYSCARESGWSHYYYYGM

DVWGQGTMVTVSS (KL2B242_HL)

SEQ ID NO: 420

MAWVWTLLFLMAAAQSIQAQVQLQESGPGLVKPSETLSLTCTVSGGSISSYYWSWLRQPAGSG

LEWIGRLYVSGFTNYNPSLKSRVTLSLDPSRNQLSLKLSSVTAADTAVYYCAGDSGNYWGWFDP

WGQGTLVTVSSGGSEGKSSGSGSESKSTGGSSYELTQPPSVSVSPGETASITCSGDQLGENYACW

YQQKPGQSPVLVTYQDSKRPSGIPERFSGSNSGNTATLTISGTQALDEADYYCQAWDNSIVVFGG

GTKLTVL (KL2B242_LH)

SEQ ID NO: 421

MAWVWTLLFLMAAAQSIQASYELTQPPSVSVSPGETASITCSGDQLGENYACWYQQKPGQSPV

LVIYQDSKRPSGIPERFSGSNSGNTATLTISGTQALDEADYYCQAWDNSIVVFGGGTKLTVWGS

EGKSSGSGSESKSTGGSQVQLQESGPGLVKPSETLSLTCTVSGGSISSYYWSWLRQPAGSGLEWI

GRLYVSGFTNYNPSLKSRVTLSLDPSRNQLSLKLSSVTAADTAVYYCAGDSGNYWGWFDPWGQ

GTLVTVSS (KL2B467_HL)

SEQ ID NO: 422

MAWVWTLLFLMAAAQSIQAQVQLVESGGGVVQPGRSLRLSCAASGFTFSYYGMHWVRQAPGK

GLEWVAFISYDGSNKYYADSVKGRFTISRDNSKNTLYLQMNSLRAEDTAVYYCAHLPYSGSYW

AFDYWGQGTQVTVSSggsegkssgsgseskstggsQSVLTQPPSVSVAPGQTASITCGGDNIGSKSVHWY

QQKPGQAPVLVVYDNSDRPSGIPERFSGSNSGTTATLTISRVEAGDEADYYCQVWDSSSDHPVVF

GGGTKVTV (KL2B467_LH)

SEQ ID NO: 423

MAWVWTLLFLMAAAQSIQAQSVLTQPPSVSVAPGQTASITCGGDNIGSKSVHWYQQKPGQAPV

LVVYDNSDRPSGIPERFSGSNSGTTATLTISRVEAGDEADYYCQVWDSSSDHPVVFGGGTKVTVg gsegkssgsgseskstggsMAWVWTLLFLMAAAQSIQAQVQLNESGGGVVQPGRSLRLSCAASGFTFSY

YGMHWVRQAPGKGLEWVAFISYDGSNKYYADSVKGRFTISRDNSKNTLYLQMNSLRAEDTAV

YYCAHLPYSGSYWAFDYWGQGTQVTVSS (KL2B494_HL)

SEQ ID NO: 424

QVQLVESGGGLVQPGGSLRLSCAASGFTFSHYAMSWVRQAPGKGLEWVSTIGGSGGSTYYADS

VKGRFTISRDNSKNTLYLQMNSLRAEDTAVYYCAKPHIVNWTALLYDGMDVWGQGTMVTVSS

GGSEGKSSGSGSESKSTGGSSSELTQPPSVSVAPGQTARITCGGNNIGSKSVHWYQQKPGQAPVL

VVYDDSDRPSGIPERFSGSNSGNTATLTISRVEAGDEADYYCQVWDSSSDHVVFGGGTKLTVL (KL2B494_LH)

SEQ ID NO: 425

MAWVWTLLFLMAAAQSIQASSELTQPPSVSVAPGQTARITCGGNNIGSKSVHWYQQKPGQAPV

LVVYDDSDRPSGIPERFSGSNSGNTATLTISRVEAGDEADYYCQVWDSSSDHVVFGGGTKLTVL

GGSEGKSSGSGSESKSTGGSQVQLVESGGGLVQPGGSLRLSCAASGFTFSHYAMSWVRQAPGKG

LEWVSTIGGSGGSTTYADSVKGRFTISRDNSKNTLYLQMNSLRAEDTAVYYCAKPHIVMVTALL

YDGMDVWGQGTMVTVSS

CAR 1 (HL_HCG5_LCD6_20AA; pDR000083431)

SEQ ID NO: 46

QVQLQESGPGLNKPSDTLSLTCAVSGNSITSDYAWNWIRQFPGKGLEWMGYISYSGSTTYNPSL

KSRVTISRDTSKNQTSLKLSSVTPVDTAVYYCATGYYYGSGFWGQGTLVTVSSGGSEGKSSGSG

SESKSTGGSDIVLTQSPDSLAVSLGERATINCKASESVEYFGTSLMHWYQQKPGQPPKLLIYAAS

-continued

NRESGVPDRFSGSGSGTDFTLTIQSVQAEDVSVYFCQQTRKVPYTFGQGTKILEIKTSTPAPRPPTP

APTIASQPLSLRPEACRPAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQ

GLSTATKDTYDALHMQALPPR

CAR 2 (HL_HCG5_LCHumanized_20AA: pDR000083432)
SEQ ID NO: 47

QVQLQESGPGLVKPSDTLSLTCAVSGNSITSDYAWNWIRQFPGKGLEWMGYISYSGSTTYNPSL

KSRVTISRDTSKNQFSLKLSSVTPVDTAVYYCATGYYYGSGFWGQGTLVTVSSGGSEGKSSGSG

SESKSTGGSDIVLTQSPDSLAVSLGERATINCKASESVEYFGTSLMHWVQQKPGQPPKLLIYAAS

NRESGVPDRFSGSGSGTDETLTISSLQAEDVAVYYCQQTRKVPYTFGQGTKLEIKTSTPAPRPPTP

APTIASQPLSLRPEACRPAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQ

GLSTATKDTYDALHMQALPPR

CAR 3 (HL_HCF3_LCB7_20AA; pDR000083436)
SEQ ID NO: 48

QVQLQESGPGLVKPSDTLSLTCAVSGNSITSDYAWNWIRQFPGKGLEWIGYISYSGSTTYNPSLK

SRVTISRDTSKNQFSLKLSSVTPVDTAVYYCATGYYYGSGFWGQGTLVTVSSGGSEGKSSGSGSE

SKSTGGSDIVLTQSPDSLAVSLGERATINCKASESVEYEGTSLMHWYQQKPGQPPKLLIYAASNR

ESGVPDRFSGSGSGTDFTLTISSVQAEDVAVYYCQQTRKVPYTFGQGTKLEIKTSTPAPRPPTPAP

TIASQPLSLRPEACRPAAGGAVHTRGLDFACDIYIWAPLAGTCGVLLLSLVITLYCKRGRKKLLYI

FKQPFMRPVQTTQEEDGCSCRFPEEEEGGCELRVKFSRSADAPAYKQGQNQLYNELNLGRREEY

DVLDKRRGRDPEMGGKPRRKNPQEGLYNELQKDKMAEAYSEIGMKGERRRGKGHDGLYQGLS

TATKDTYDALHMQALPPR

CAR 4 (HL_HCG5_LCB7_20AA; pDR000083437)
SEQ ID NO: 49

QVQLQESGPGLVKPSDTLSLTCAVSGNSITSDYAWNWIRQFPGKGLEWMGYISYSGSTTYNPSL

KSRVTISRDTSKNQFSLKLSSVTPVDTAVYYCATGYYYGSGFWGQGTLVTVSSGGSEGKSSGSG

SESKSTGGSDIVLTQSPDSLAVSLGERATINCKASESVEYFGTSLMHWYQQKPGQPPKLLIYAAS

NRESGVPDRFSGSGSGTDFTLTISSVQAEDVAVYYCQQTRKVPYTFGQGTKLEIKTSTPAPRPPTP

APTIASQPLSLRPEACRPAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQ

GLSTATKDTYDALHMQALPPR

CAR 5 (LH_LCD6_HCG5_20AA; pDR000083438)
SEQ ID NO: 50

DIVLTQSPDSLAVSLGERATINCKASESVEYFGTSLMHWYQQKPGQPPKLLIYAASNRESGVPDR

FSGSGSGTDFTLTIQSVQAEDVSVYFCQQTRKVPYTFGQGTKLEIKGGSEGKSSGSGSESKSTGGS

QVQLQESGPGLVKPSDTLSLTCAVSGNSITDYAWNWIRQFPGKGLEWMGYISYSGSTTYNPSL

KSRVTISRDTSKNQFSLKLSSVTPVDTAVYYCATGYYYGSGFWGQGTLVTVSSTSTPAPRPPTPA

PTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLYNELNLGRRE

EYDVLDKRRGRDPEMGGKPRRKNPQEGLYNELQKDKMAEAYSEIGMKGERRRGKGHDGLYQ

GLSTATKDTYDALHMQALPPR

CAR 6 (LH_LCHumanized_HCF3_20AA; pDR000083440)
SEQ ID NO: 51

DIVLTQSPDSLAVSLGERATINCKASESVEYFGTSLMHWYQQKPGQPPKLLIYAASNRESGVPDR

FSGSGSGTDFTLTISSLQAEDVAVYYCQQTRKVPYTFGQGTKLEIKGGSEGKSSGSGSESKSTGGS

QVQLQESGPGLVKPSDTLSLTCAVSGNSITSDYAWNWIRQFPGKGLEWIGYISYSGSTTYNPSLK

SRVTISRDTSKNQFSLKLSSVTPVDTAVYYCATGYYYGSGFWGQGTLVTVSSTSTPAPRPPTPAP

TIASQPLSLRPEACRPAAGGAVHTRGLDFACDIYIWAPLAGTCGVLLLSLVITLYCKRGRKKLLYI

FKQPFMRPVQTTQEEDGCSCRFPEEEEGGCELRVKFSRSADAPAYKQGQNQLYNELNLGRREEY

DVLDKRRGRDPEMGGKPRRKNPQEGLYNELQKDKMAEAYSEIGMKGERRRGKGHDGLYQGLS

TATKDTYDALHMQALPPR

CAR 7 (LH_LCHumanized_HCG5_20AA; pDR000083441)
SEQ ID NO: 52

DIVLTQSPDSLAVSLGERATINCKASESVEYFGTSLMHWYQQKPGQPPKLLIYAASNRESGVPDR

FSGSGSGTDFTLTISSLQAEDVAVYYCQQTRKVPYTFGQGTKLEIKGGSEGKSSGSGSESKSTGGS

QVQLQESGPGLVKPSDTLSLTCAVSGNSITSDYAWNWIRQFPGKGLEWMGYISYSGSTTYNPSL

KSRVTISRDTSKNQFSLKLSSVTPVDTAVYYCATGYYYGSGFWGQGTLVTVSSTSTPAPRPPTPA

PTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLYNELNLGRRE

EYDVLDKRRGRDPEMGGKPRRKNPQEGLYNELQKDKMAEAYSEIGMKGERRRGKGHDGLYQ

GLSTATKDTYDALHMQALPPR

CAR 8 (LH_LCB7_HCF3_20AA; pDR000083443)
SEQ ID NO: 53

DIVLTQSPDSLAVSLGERATINCKSESVEYFGTSLMHWYQQKPGQPPKLLIYAASNRESGVPDR

FSGSGSGTDFTLTISSVQAEDVAVYYCQQTRKVPYTFGQGTKLEIKGGSEGKSSGSGSESKSTGGS

QVQLQESGPGLNKPSDTLSLTCAVSGNSITSDYAWNWIRQFPGKGLEWIGYISYSGSTTYNPSLK

SRVTISRDTSKNQFSLKLSSVTPVDTAVYYCATGYYYGSGFWGQGTLVTVSSTSTPAPRPPTPAP

TIASQPLSLRPEACRPAAGGAVHTRGLDFACDIYIWAPLAGTCGVLLLSLVITLYCKRGRKKLLYI

FKQPFMRPVQTTQEEDGCSCRFPEEEEGGCELRVKFSRSADAPAYKQGQNQLYNELNLGRREEY

DVLDKRRGRDPEMGGKPRRKNPQEGLYNELQKDKMAEAYSEIGMKGERRRGKGHDGLYQGLS

TATKDTYDALHMQALPPR

CAR 9 (LH_LCB7_HCG5_20AA; pDR000083444)
SEQ ID NO: 54

DIVLTQSPDSLAVSLGERATINCKASESVEYFGTSLMHWYQQKPGQPPKLLIYAASNRESGVPDR

FSGSGSGTDFTLTISSVQAEDVAVYYCQQTRKVPYTFGQGTKLEIKGGSEGKSSGSGSESKSTGGS

QVQLQESGPGLVKPSDTLSLTCAVSGNSITSDYAWNWIRQFPGKGLEWMGYISYSGSTTYNPSL

KSRVTISRDTSKNQFSLKLSSVTPVDTAVYYCATGYYYGSGFWGQGTLLNTVSSTSTPAPRPPTPA

PTIASQPLSLRPEACRPAAGGAVHTRGLDFACDIYIWAPLAGTCGVLLLSLVITLYCKRGRKKIL

YIFKQPFMRPVQTTQEEDGCSCRFPEEEEGGCELRVKFSRSADAPAYKQGQNQINNELNLGRRE

EYDVLDKRRGRDPEMGGKPRRKNPQEGLYNELQKDKMAEAYSEIGMKGERRRGKGHDGLYQ

GLSTATKDTYDALHMQALPPR

-continued

CAR 10 (LH_LCD6_HCF3_20AA; pDR000083446)
SEQ ID NO: 55
DIVLTQSPDSLAVSLGERATINCKASESVEYFGTSLMHWYQQKPGQPPKWLLIYAASNRESGVPDR

FSGSGSGTDFTLTIQSVQAEDVSVYFCQQTRKVPYTFGQGTKLEIKGGSEGKSSGSGSESKSTGGS

QVQLQESGPGINKPSDTLSLTCAVSGNSITSDYAWNWIRQFPGKGLEWIGYISYSGSTTYNPSLK

SRVTISRDTSKNQFSLKLSSVTPVDTAVYYCATGYYYGSGFWGQGTLVTVSSTSTPAPRPPTPAP

TIASQRLSLRPEACRPAAGGAVHTRGLDFACDIYIWAPLAGTCGVLLLSLVITLYCKRGRKKLLYI

FKQPFMRPVQTTQEEDGCSCRFPEEEEGGCELRVKFSRSADAPAYKQGQNQLYNELNLGRREEY

DVLDKRRGRDPEMGGKPRRKNPQEGLYNELQKDKMAEAYSEIGMKGERRRGKGHDGLYQGLS

TATKDTYDALHMQALPPR

CAR 11 (HL_HCHumanized_LCB7_20AA; pDR000083433)
SEQ ID NO: 56
QVQLQESGPGLVKPSDTLSLTCAVSGNSITSDYAWNWIRQPPGKGLEWIGYISYGSTTYNPSLK

SRVFMSRDTSKNQFSLKLSSVTAVDTAVYYCATGYYYGSGFWGQGTLVTVSSGGSEGKSSGSG

SESKSTGGSDIVLTQSPDSLAVSLGERATINCKASESVEYFGTSLMHWYQQKPGQPPKLLIYAAS

NRESGVPDRFSGSGSGTDFTLTISSVQAEDVAVYYCQQTRKVPYTFGQGTKLEIKTSTPAPRPPTP

APTIASQPLSLRPEACRPAAGGAVHTRGLDFACDIYIWAPLAGTCGVLLLSLVITLYCKRGRKKL

LTIFKQPFMRPVQTTQEEDGCSCREPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQ

GLSTATKDTYDALHMQALPPR

CAR 12 (HL_HCHumanized_LCD6_20AA; pDR000083434)
SEQ ID NO: 57
QVQLQESGPGLVKPSDTLSLTCAVSGNSITSDYAWNWIRQPPGKGLEWIGYISYSGSTTYNPSLK

SRVTMSRDTSKNQFSLKLSSVTAVDTAVYYCATGYYYGSGFWGQGTLVTYSSGGSEGKSSGSG

SESKSTGGSDIVLTQSPDSLAVSLGERATINCKASESVEYFGTSLMHWYQQKPGQPPKLLIYAAS

NRESGVPDRESGSGSGTDFTLTIQSVQAEDVSVYFCQQTRKVPYTEGQGTKLEIKTSTPAPRPTP

APTIASQPLSLRPEACRPAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQ

GLSTATKDTYDALHMQALPPR

CAR 13 (HL_HCHumanized_LCHumanized_20AA; pDR000083435)
SEQ ID NO: 58
QVQLQESGPGLVKPSDTLSLTCAVSGNSITSDYAWNWIRQPPGKGLEWIGYISYSGSTTYNPSLK

SRVTMSRDTSKNQFSLKLSSVTAVDTAVYYCATGYYYGSGFWGQGTLVTVSSGGSEGKSSGSG

SESKSTGGSDIVLTQSPDSLAVSLGERATINCKASESVEYFGTSLMHWYQQKPGQPPKLLIYAAS

NRESGVPDRFSGSGSGTDFTLTISSLQAEDVAVYYCQQTRKVPTFGQGTKLEIKTSTPAPRPPTP

APTIASQPLSLRPEACRPAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQ

GLSTATKDTYDALHMQALPPR

CAR 14 (LH_LCD6_HCHumanized_20AA; pDR000083439)
SEQ ID NO: 59
DIVLTQSPDSLAVSLGERATINCKASESVEYFGTSLMHWYQQKPGQPPKLLIYAASNRESGVPDR

FSGSGSGTDFTLTIQSVQAEDVSVYFCQQTRKVPYTFGQGTKLEIKGGSEGKSSGSGSESKSTGGS

QVQLQESGPGLVKPSDTLSLTCAVSGNSITSDYAWNWIRQPPGKGLEWIGYISYSGSTTYNPSLK

```
SRVTMSRDTSKNQFSLKLSSVTAVDTAVYYCATGYYYGSGFWGQGTLVTVSSTSTPAPRPPTPA

PTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLYNELNLGRRE

EYDVLDKRRGRDPEMGGKPRRKNPQEGLYNELQKDKMAEAYSEIGMKGERRRGKGHDGLYQ

GLSTATKDTYDALHMQALPPR

CAR 15 (LH_LCHumanized_HCHumanized_20AA; pDR000083442)
                                                              SEQ ID NO: 60
DIVLTQSPDSLAVSLGERATINCKASESVEYFGTSLMHWYQQKPGQPPKLLIYAASNRESGVPDR

FSGSGSGTDFTLTISSLQAEDVAVYYCQQTRKVPYTFGQGTKLEIKGGSEGKSSGSGSESKSTGGS

QVQLQESGPGLVKPSDTLSLTCAVSGNSITSDYAWNWIRQPPGKGLEWIGYISYSGSTTYNPSLK

SRVTMSRDTSKNQFSLKLSSVTAVDTAVYYCATGYYYGSGFWGQGTLVTVSSTSTPAPRPRTPA

PTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLYNELNLGRRE

EYDVLDKRRGRDPEMGGKPRRKNPQGLYNELQKDKMAEAYSEIGMKGERRRGKGHDGLYQ

GLSTATKDTYDALHMQALPPR

CAR 16 (LH_LCB7__HCHumanized_20AA; pDR000083445)
                                                              SEQ ID NO: 61
DIVLTQSPDSLAVSLGERATINCKASESVEYFGTSLMHWYQQKPGQPPKLLIYAASNRESGVPDR

FSGSGSGTDFTLTISSVQAEDVAVYYCQQTRKVPYTFGQGTKLEIKGGSEGKSSGSGSESKSTGGS

QVQLQESGPGINKPSDTLSLTCAVSGNSITSDYAWNWIRQPPGKGLEWIGYISYSGSTTYNPSLK

SRVTMSRDTSKNQFSLKLSSVTAVDTAVYYCATGYYYGSGFWGQGTLVTVSSTSTPAPRPPTPA

PTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLYNELNLGRRE

EYDVLDKRRGRDPEMGGKPRRKNPQEGLYNELQKDKMAEAYSEIGMKGERRRGKGHDGLYQ

GLSTATKDTYDALHMQALPPR

>CAR 17 (KL2B413_HL; PBD000091628)
                                                              SEQ ID NO: 153
EVQLVESGGGLVQPGGSLRLSCAASGFTFSSYWMTWVRQAPGKGLEWVANIKQDGSERYYVDS

VKGRFTISRDNAKNSLYLQMNSLRAEDTAVYYCARDQNYDILTGHYGMDVWGQGTTVTVSSG

GSEGKSSGSGSESKSTGGSEIVLTQSPSFLSASVGDRVTITCRASQGISSYLSWYQQKPGKAPKLLI

YATSTLQSGVPSRFSGSGSGTEFTLTISSLQPEDFATYYCQQLNSYPRTFGQGTKVEIKTSTPAPRP

PTPAPTIASQPLSLRPEACRPAAGGAVHTRGLDFACDIYIWAPLAGTCGVLLLSLVITLYCKRGRK

KLLYIFKQPFMRPVQTTQEEDGCSCRFPEEEEGGCELRVKFSRSADAPAYKQGQNQLYNELNLG

RREEYDVLDKRRGRDPEMGGKPRRKNPQEGLYNELQKDKMAEAYSEIGMKGERRRGKGHDGL

YQGLSTATKDTYDALHMQALPPR

>CAR 18 (KL2B413_LH: PBD000091623)
                                                              SEQ ID NO: 154
EIVLIQSPSFLSASVGDRVTITCRASQGISSYLSWYQQKPGKAPKLLIYATSTLQSGVPSRFSGSGS

GTEFTLTISSLQPEDFATYYCQQLNSYPRTFGQGTKVEIKGGSEGKSSGSGSESKSTGGSEVQLVE

SGGGLVQPGGSLRLSCAASGFTFSSYWMTWVRQAPGKGLEWVANIKQDGSERYYVDSVKGRFT

ISRDNAKNSLYLQMNSLRAEDTAVYYCARDQNYDILTGHYGMDVWGQGTTVTVSSTSTPAPRP

PTPAPTIASQPLSLRPEACRPAAGGAVHTRGLDFACDIYIWAPLAGTCGVLLLSVITLYCKRGRK

KLLYIFKQPFMRPVQTTQEEDGCSCRFPEEEEGGCELRVKFSRSADAPAYKQGQNQLYNELNLG

RREEYDVLDKRRGRDPEMGGKPRRKNPEGLYNELQKDKMAEAYSEIGMKGERRRGKGHDGL

YQGLSTATKDTYDALHMQALPPR
```

```
>CAR 19 (KL2B359_HL; PBD000091576)
                                                       SEQ ID NO: 155
QVQLQESGPGLVKPSQTLSLTCTVSGNSITSDYAWNWIRQFPGKRLEWIGYISYSGSTTYNPSLKS

RVTISRDTSKNQFSLKLSSVTAADTAVYYCATGYYYGSGFWGQGTLVTVSSGGSEGKSSGSGSE

SKSTGGSEIVLTQSPATLSLSPGERATLSCRASESVEYFGTSLMHWYQQKPGQPPRLLIYAASNVE

SGIPARFSGSGSGTDFTLTISSVEPEDFAVYFCQQTRKVPYTFGGGTKVEIKTSTPAPRPPTPAPTIA

SQPLSLRPEACRPAAGGAVHTRGLDFACDIYIWAPLAGTCGVLLLSLVITLYCKRGRKKLLYIFK

QPFMRPVQTTQEEDGCSCRFPEEEEGGCELRVKFSRSADAPAYKQGQNQLYNELNLGRREEYDV

LDKRRGRDPEMGGKPRRKNPQEGLYNELQKDKMAEAYSEIGMKGERRRGKGHDGLYQGLSTA

TKDTYDALHMQALPPR

>CAR 20 (KL2B359_LH; PBD000091577)
                                                       SEQ ID NO: 156
EIVLTQSPATLSLSPGERATLSCRASESVEYTGTSLMHWYQQKPGQPPRLLIYAASNVESGIPARF

SGSGSGTDFTLTISSVEPEDFAVYFCQQTRKVPYTFGGGTKVEIKGGSEGKSSGSGSESKSTGGSQ

VQLQESGPGLVKPSQTLSLTCTVSGNSITSDYAWNWIRQFPGKRLEWIGYISYSGSTTYNPSLKSR

VTISRDTSKNQFSLKLSSVTAADTAVYYCATGYYYGSGFWGQGTLVTVSSTSTPAPRPPTPAPTI

ASQPLSLRPEACRPAAGGAVHTRGLDFACDIYIWAPLAGTCGVLLLSLVITLYCKRGRKKLLYIF

KQPFMRPVQTTQEEDGCSCRFPEEEEGGCELRVKFSRSADAPAYKQGQNQLYNELNLGRREEYD

VLDKRRGRDPEMGGKPRRKNPQEGLYNELQKDKMAEAYSEIGMKGERRRGKGHDGLYQGLST

ATKDTYDALHMQALPPR (CAR21)
                                                       SEQ ID NO: 426
QVQLQESGPGLVKPSQTLSLTCTVSGNSITSDYAWNWIRQFPGKGLEWIGYISYSGSTTYNPSLKS

RVTISRDTSKNQFSLKLSSVTAADTAVYYCATGYYYGSGFWGQGTLVTVSSggsegkssgsgseskstggs

DIVLTQSPDSLAVSLGERATINCRASESVEYFGTSLMHWYQQKPGQPPKLLIYAASNVESGVPDR

FSGSGSGTDFTLTISSLQAEDVAVYTCQQTRKVPYTFGGGTKVEIKTSTPAPRPPTPAPTIASQPLS

LRPEACRPAAGGAVHTRGLDFACDFYIWAPLAGTCGVLLLSLVITLYCKRGRKKLLYIFKQPFMR

PVQTTQEEDGCSCRFPEEEEGGCELRVKFSRSADAPAYKQGQNQLYNELNLGRREEYDVLDKRR

GRDPEMGGKPRRKNPQEGLYNELQKDKMAEAYSEIGNIKGERRRGKGHDGLYQGLSTATKDTY

DALHMQALPPR (CAR22)
                                                       SEQ ID NO: 427
DIVLTQSPDSLAVSLGERATINCRASESVEYTGTSLMHWYQQKPGQPPKLLIYAASNVESGVPDR

FSGSGSGTDFTLTISSLQAEDVAVYFCQQTRKVPYTFGGGTKVEIKggsegkssgsgseskstggsQVQLQE

SGPGLVKPSQTLSLTCTVSGNSITSDYAWNWIRQFPGKGLEWIGYISYSGSTTYNPSLKSRVTISR

DTSKNQFSLKLSSVTAADTAVYYCATGYYYGSGFWGQGTLVTVSSTSTPAPRPPTPAPTIASQPL

SLRPEACRPAAGGAVHTRGLDFACDIYIWAPLAGTCGVLLLSLVITLYCKRGRKKLLYIFKQPFM

RPVQTTQEEDGCSCRPEEEEGGCELRVKFSRSADAPAYKQGQNQLYNELNLGRREEYDVLDKR

RGRDPEMGGKPRRKNPQEGLYNELQKDKMAEAYSEIGMKGERRRGKGHDGLYQGLSTATKDT

YDALHMQALPPR (CAR23)
                                                       SEQ ID NO: 428
QVQLQESGPGLVKKPSQTLSLTCTVSGNSITSDYAWNWIRQPPGKGLEWIGYISYSGSTTYNPSLKS

RVTISRDTSKNQFSLKLSSVTAADTAVYYCATGYYYGSGFWGQGTLVTVSSggsegkssgsgseskstggs

EIVLTQSPATLSLSPGERATLSCRASESVEYFGTSLMHWYQQKPGQPPRLLIYAASNVESGIPARF
```

-continued

SGSGSGTDFTLTISSVEPEDFAVYFCQQTRKVPYTFGGGTKVEIKTSTPAPRPPTPAPTIASQPLSLR

PEACRPAAGGAVHTRGLDFACDIYIWAPLAGTCGVLLLSLVITLYCKRGRKKLLYIFKQPFMRPV

QTTQEEDGCSCRFPEEEEGGCELRVKFSRSADAPAYKQGQNQLYNELNLGRREEYDVLDKRRG

RDPEMGGKPRRKNPQEGLYNELQKDKMAEAYSEIGMKGERRRGKGHDGLYQGLSTATKDTYD

ALHMQALPPR (CAR24)

SEQ ID NO: 429

QVQLQESGPGLVKPSQTLSLTCTVSGNSITSDYAWNWIRQPPGKGLEWIGYISYSGSTTYNPSLKS

RVTISRDTSKNQESLKLSSVTAADTAVYYCATGYYYGSGFWGQGTLVTVSSggsegkssgsgseskstggs

EIVLTQSPATLSLSPGERATLSCRASESVEYFGTSLMEIWYQQKPGQPPRILIYAASNVESGIPARF

SGSGSGTDFTLTISSVEPEDFAVYFCQQTRKVPYTFGGGTKVEIKTSTPAPRPPTPAPTIASQPLSLR

PEACRPAAGGAVHTRGLDFACDIYIWAPLAGTCGVLLLSLVITLYCKRGRKKLLYIFKQPFMRPV

QTTQEEDGCSCREPEEEEGGCELRVKFSRSADAPAYKQGQNQLYNELNLGRREEYDVLDKRRG

RDPEMGGKPRRKNPQEGLYNELQKDKMAEAYSEIGMKGERRRGKGHDGLYQGLSTATKDTYD

ALHMQALPPR (CAR:25)

SEQ ID NO: 430

QVQLQESGPGLVKPSQTLSTCTVSGNSITSDYAWNWIRQFPGKGLEWIGYISYSGSMNPSLKS

RVTISRDTSKNQFSLKLSSVTAADTAVYYCATGYYYGSGFWGQGTLVTVSSggsegkssgsgseskstggs

EIVLTQSPATLSLSPGERATLSCRASESVEYFGTSLMHWYQQKPGQPPRLLIYAASNVESGIPARF

SGSGSGTDFTLTISSVEPEDFAVYFCQQTRKVPYTFGGGTKVEIKTSTPAPRPPTPAPTIASQPLSLR

PEACRPAAGGAVHTRGLDFACDIYIWAPLAGTCGVLLLISLVITLYCKRGRKKLLYIFKQPFMRPV

QTTQEEDGCSCRFPEEEEGGCELRVKFSRSADAPAYKQGQNQLYNELNLGRREEYDVLDKRRG

RDPEMGGKPRRKNPQEGLYNELQKDKMAEAYSEIGMKGERRRGKGHDGLYQGLSTATKDTYD

ALHMQALPPR (CAR26)

SEQ ID NO: 431

QVQLQESGPGLVKPSQTLSTCTVSGNSITSDYAWNWIRQFPGKGLEWIGYISYSGSTTYNPSLKS

RVTISRDTSKNQFSLKLSSVTAADTAVYYCATGYYYGSGFWGQGTLVTVSSggsegkssgsgseskstggs

EIVLTQSPATLSLSPGERATLSCRASESVEYFGTSLMHWYQQKPGQPPRLLIYAASNVESGIPARF

SGSGSGTDFTLTISSVEPEDFAVYTCQQTRKVPYTFGGGTKVEIKTSTPAPRPPTPAPTIASQPLSLR

PEACRPAAGGAVHTRGLDFACDIYIWAPLAGTCGVLLLSLVITLYCKRGRKKLLYIFKQPFMRPV

QTTQEEDGCSCRFPEEEEGGCELRVKFSRSADAPAYKQGQNQLYNELNLGRREEYDVLDKRRG

RDPEMGGKPRRKNPQEGLYNELQKDKMAEAYSEIGMKGERRRGKGHDGLYQGLSTATKDTYD

ALHMQALPPR (CAR27)

SEQ ID NO: 432

QVQLQESGPGLVKPSETLSLTCTVSGGSISSYYWSWIRQPPGKGLEWIGYIYYSGSTNYNPSLKSR

VTISVDTSKNQFSLKLSSVTAADTAVYYCAGTTIFGVVTPNFYYGMDVWGQGTTVTVSSGGSEG

KSSGSGSESKSTGGSDIQMIQSPSFLSASVGDRVTITCRASQGISSYLAWYQQKPGKAPKELIYAA

STLQSGVPSRFSGSGSGTEFTLTISSLQPEDFATYYCQQLNSYPLTFGGGTKVEIKTSTPAPRPPTPA

PTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLYNELNLGRRE

EYDVLDKRRGRDPEMGGKPRRKNPQEGLYNELQKDKMAEAYSEIGMKGERRRGKGHDGLYQ

GLSTATKDTYDALHMQALPPR

```
(CAR28)
                                                SEQ ID NO: 433
DIQMTQSPSFLSASVGDRVTITCRASQGISSYIAWYQQKPGKAPKFLIYAASTLQSGVPSRFSGSG

SGTEFTLTISSLQPEDFATYYCQQLNSYPLTFGGGTKVEIKGGSEGKSSGSGSESKSTGGSQVQLQ

ESGPGLVKPSETLSLTCTVSGGSISSYYWSWIRQPPGKGLEWIGYIYYSGSTNYNPSLKSRVTISVD

TSKNQFSLKLSSVTAADTAVYYCAGTTIFGVVTPNFYYGMDVWGQGTTVTVSSTSTPAPRPPTP

APTIASQPLSLRPEACRPAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQ

GLSTATKDTYDALHMQALPPR (CAR29)
                                                SEQ ID NO: 434
EVQLVESGGGVVQPGRSLRLSCVASGFTFSSYDIHWVRQAPGKGLEWVAIISYDGSKKDYTDSV

KGRFTISRDNSKNTLYLQMDSLRVEDSAVYSCARESGWSHYYYYGMADVWGQGTMVTVSSGGS

EGKSSGSGSESKSTGGSDIVMTQSPSSLSASVGDRVTITCRASQDISNYLAWYQQKPGKVPKFLIY

AASTLHSGVPSRFSGSGSGTDFTLTISSLQPEDVATYYCQKYNSAPYTFGQGTRLEIKTSTPAPRPP

TPAPTIASQPLSLRPEACRPAAGGAVHTRGLDFACDIYIWAPLAGTCGVLLLSLVITLYCKRGRKK

LLYIFKQPFMRPVQTTQEEDGCSCRFPEEEEGGCELRVKFSRSADAPAYKQGQNQLYNELNLGR

REEYDVLDKRRGRDPEMGGKPRRKNPQEGLYNELQKDKMAEAYSEIGMKGERRRGKGHDGLY

QGLSTATKDTYDALHMQALPPR (CAR30)
                                                SEQ ID NO: 435
DIVMTQSPSSLSASVGDRVTITCRASQDISNYLAWYQQKPGKVPKFLIYAASTLHSGVPSRFSGSG

SGTDFTLTISSLQPEDVATYYCQKYNSAPYTFGQGTRLEIKGGSEGKSSGSGSESKSTGGSEVQLV

ESGGGVVQPGRSLRLSCVASGFTFSSYDIHWVRQAPGKGLEWVAIISYDGSKKDYTDSVKGRFTI

SRDNSKNTLYLQMDSLRVEDSAVYSCARESGWSHYYYYGMDVWGQGTMVTSSTSTPAPRPP

TPAPTIASQPLSLRPEACRPAAGGAVHTRGLDFACDIYIWAPLAGTCGVLLLSLVITLYCKRGRKK

LLYIFKQPFMRPVQTTQEEDGCSCRFPEEEEGGCELRVKFSRSADAPAYKQGQNQLYNELNLGR

REEYDVLDKRRGRDPEMGGKPRRKNPQEGLYNELQKDKMAEAYSEIGMKGERRRGKGHDGLY

QGLSTATKDTYDALHMQALPPR (CAR31)
                                                SEQ ID NO: 436
QVQLQESGPGLVKPSETLSLTCTVSGGSISSYYWSWLRQPAGSGLEWIGRLYVSGFTNYNPSLKS

RVTLSLDPSRNQLSLKLSSVTAADTAVYYCAGDSGNYWGWFDPWGQGTLVTVSSGGSEGKSSG

SGSESKSTGGSSYELTQPPSVSVSPGETASITCSGDQLGENYACWYQQKPGQSPVLVIYQDSKRPS

GIPERFSGSNSGNTATLTISGTQALDEADYYCQAWDNSIVVFGGGTKLTVLTSTPAPRPPTPAPTI

ASQPLSLRPEACRPAAGGAVHTRGLDFACDIYIWAPLAGTCGVLLLSLVITLYCKRGRKKLLYIF

KQPFMRPVQTTQEEDGCSCRFPEEEEGGCELRVKFSRSADAPAYKQGQNQLYNELNLGRREEYD

VLDKRRGRDPEMGGKPRRKNPQEGLYNELQKDKMAEAYSEIGMKGERRRGKGHDGLYQGLST

ATKDTYDALHMQALPPR (CAR32)
                                                SEQ ID NO: 437
SYELTQPPSVSVSPGETASITCSGDQLGENYACWYQQKPGQSPVLVTYQDSKRPSGIPERFSGSNS

GNTATLTISGTQALDEADYYCQAWDNSIVVFGGGTKLTVLGGSEGKSSGSGSESKSTGGSQVQL

QESGPGLVKPSETLSLTCTVSGGSISSYYWSWLRQPAGSGLEWIGRLYVSGFTNYNPSLKSRVTL
```

-continued

SLDPSRNQLSLKLSSVTAADTAVYYCAGDSGNYWGWFDPWGQGTLVTVSSTSTPAPRPPTPAPT

IASQPLSLRPEACRPAAGGAVHTRGLDFACDIYIWAPLAGTCGVLLLSLVITLYCKRGRKKLLYIF

KQPFMRPVQTTQEEDGCSCRFPEEEEGGCELRVKFSRSADAPAYKQGQNQLYNELNLGRREEYD

VLDKRRGRDPEMGGKPRRKNPQEGLYNELQKDKMAEAYSEIGMKGERRRGKGHDGLYQGLST

ATKDTYDALHMQALPPR (CAR33)
SEQ ID NO: 438
QVQLVESGGGVVQPGRSLRLSCAASGFTFSYYGMHWVRQAPGKGLEWVAFISYDGSNKYYAD

SVKGRFTISRDNSKNTLYLQMNSLRAEDTAVYYCAHLPYSGSYWAFDYWGQGTQVTVSSggsegk ssgsgseskstggsQSVLTQPPSVSVAPGQTASITCGGDNIGSKSVHWYQQKPGQAPVLVVYDNSDRPS

GIPERFSGSNSGTTATLTISRVEAGDEADYYCQVWDSSSDHPVVFGGGTKVTVTSTPAPRPPTPAP

TIASQPLSLRPEACRPAAGGAVHTRGLDFACDIYIWAPLAGTCGVLLLSLVITLYCKRGRKKLLYI

FKQPFMRPVQTTQEEDGCSCRFPEEEEGGCELRVKFSRSADAPAYKQGQNQLYNELNLGRREEY

DVLDKRRGRDPEMGGKPRRKNPQEGLYNELQKDKMAEAYSEIGMKGERRRGKGHDGLYQGLS

TATKDTYDALHMQALPPR (CAR34)
SEQ ID NO: 439
QSVLTQPPSVSVAPGQTASITCGGDNIGSKSVHWYQQKPGQAPVLVVYDNSDRPSGIPERFSGSN

SGTTATLTISRVEAGDEADYYCQVWDSSSDHPVVFGGGTKVTVggsegkssgsgseskstggsQVQLVES

GGGVVQPGRSLRLSCAASGFTFSYYGMHWVRQAPGKGLEWVAFISYDGSNKYYADSVKGRFTI

SRDNSKNTLYLQMNSLRAEDTAVYYCAHLPYSGSYWAFDYWGQGTQVTVSSTSTPAPRPPTPA

PTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLXNELNLGRRE

EYDVLDKRRGRDPEMGGKPRRKNPQEGLYNELQKDKMAEAYSEIGMKGERRRGKGHDGLYQ

GLSTATKDTYDALHMQALPPR (CAR35)
SEQ ID NO: 440
QVQLVESGGGLVQPGGSLRLSCAASGFTFSHYAMSWVRQAPGKGLEWVSTIGGSGGSTYYADS

VKGRFTISRDNSKNTLYLQMNSLRAEDTAVYYCAKPHIVMVTALLYDGMDVWGQGTMVTVSS

GGSEGKSSGSGSESKSTGGSSSELTQPPSVSVAPGQTARITCGGNNIGSKSVHWYQQKPGQAPVL

VVYDDSDRPSGIPERESGSNSGNTATLTISRVEAGDEADYYCQVWDSSSDHVVFGGGTKLTVLTS

TPAPRPPTPAPTIASQPLSLRPEACRPAAGGAVHTRGLDFACDIYIWAPLAGTCGVLLLSLVITLYC

KRGRKKLLYIFKQPFMRPVQTTQEEDGCSCRFPEEEEGGCELRVKFSRSADAPAYKQGQNQLYN

ELNLGRREEYDVLDKRRGRDPEMGGKPRRKNPQEGLYNELQKDKMAEAYSEIGMKGERRRGK

GHDGLYQGLSTATKDTYDALHMQALPPR (CAR36)
SEQ ID NO: 441
SSELTQPPSVSVAPGQTARITCGGNNIGSKSVHWYQQKPGQAPVLVVYDDSDRPSGIPERFSGSN

SGNTATLTISRVEAGDEADYYCQVWDSSSDHVVFGGGTKLTVLGGSEGKSSGSGSESKSTGGSQ

VQLVESGGGLVQPGGSLRLSCAASGFTFSHYAMSWVRQAPGKGLEWVSTIGGSGGSTYYADSV

KGRFTISRDNSKNTLYLQMNSLRAEDTAVYYCAKPHIVMVTALLYDGMDVWGQGTMVTVSST

STPAPRPPTPAPTIASQPLSLRPEACRPAAGGAVHTRGLDFACDIYWAPLAGTCGVLLSLVITLY

CKRGRKKLLYIFKQPFMRPVQTTQEEDGCSCRFPEEEEGGCELRVKFSRSADAPAYKQGQNQLY

NELNLGRREEYDVLDKRRGRDPEMGGKPRRKNPQEGLYNELQKDKMAEAYSEIGMKGERRRG

KGHDGLYQGLSTATKDTYDALHMQALPPR

To identify different scFv based CARs, their antigen-dependent activation via Jurkat-Lucia™ NFAT Cells (JNLs) was assessed. Nuclear factor of activated T-cells (NFAT) is a family of transcription factors first identified as a regulator of immune cells. T cell activation leads to calcium influx, activating calcineurin that dephosphorylates serine rich nuclear localization signal at the N-terminus of NFAT, leading to nuclear import of NFAT. Without wishing to be bound by theory, tonic signaling due to scFv clustering could be subsequently detected by Firefly luciferase driven by NFAT promoter in JNL reporter cell line.

Lentiviral transduction was performed as follows. JNL cells were harvested and re-suspended to 1E6/ml. 500 µl of JNL cells and lentiviral virus were added at a MOI of 3, and mixed by pipetting up and down. The mixture was incubated in a 37° C. incubator for 24 hours. 500 µl JNL media was added to each well, with culturing continued in a 37° C. incubator. The cells were transferred to a T25 flask on day 4. At days 5-6, transduction validation was performed. 150 µl of cells was harvested to examine CAR expression via appropriate detection reagent for the specific CAR used (e.g. biotin-hK2 protein to detect CAR). The JNL cells were maintained at $5\times10^5$/ml until enough cells were obtained to either freeze down or use in the assay.

The thermally stabilized scFv CARs were evaluated in a JNL reporter assay for antigen-dependent activity. Jurkat cells containing the luciferase gene driven by the signaling-responsive NFAT promoter were transduced with the various hK2 CAR constructs. The assay was performed as follows. Co-culturing with target cell lines was performed at an effector to target ratio of 2:1. The JNL cells were spun down to remove any secreted luciferase in the medium; the JNL cells were then resuspend in fresh media at $4\times10^5$/ml. The cells were harvested. Then, both antigen-positive and antigen-negative target cell lines were prepared at 2E5/ml. 100 µl JNL was added to 100 µl target cells. For the JNL-only control, 100 µl media was added instead of target cells. For positive control, JNL cells only or CAR JNL cells were added to 1× Cell Stimulation Cocktail and incubate in a 37° C. incubator for 24 hours. 150 µl of the supernatant was harvested into a 96-well plate and centrifuged to remove cells. 100 µl of supernatant was transferred from the plate to a solid bottom black plate. Then, 100 µl QUANTI-luc lucia detection reagent was added. The mixture was incubated at room temperature for 5 minutes before reading with Envision multiplate reader.

Figure 17:
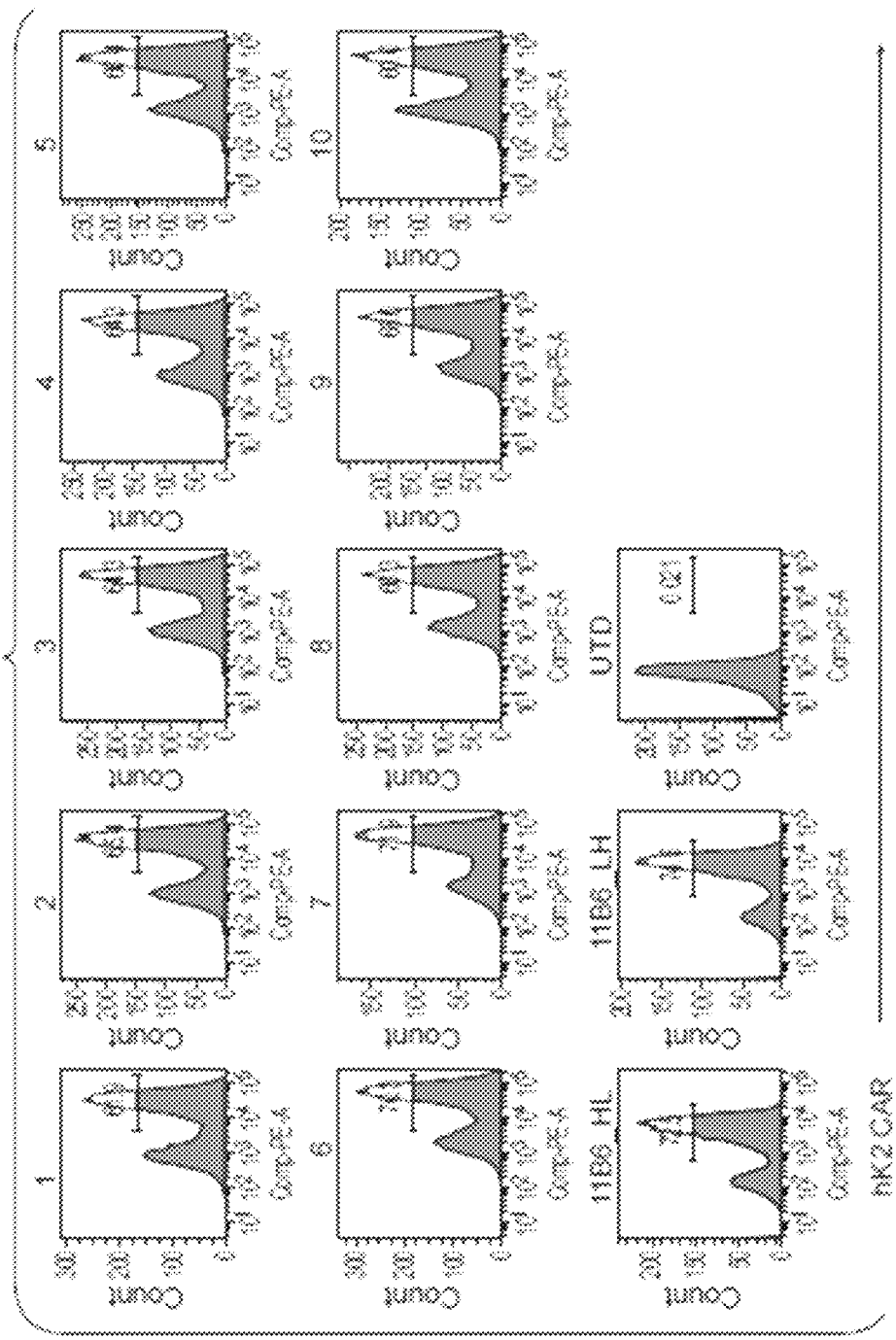
FIG. 17 shows expression of hK2 CAR constructs (constructs 1-10) on Jurkat cells containing luciferase gene driven by the signaling-responsive NFAT promoter (JNL cells) transduced with the various hK2 CAR constructs as shown in the Figure. Expression was determined by biotinylated hK2 followed by streptavidin-conjugated PE.

CAR expression (CARs 1-10) on JNL cells was determined by biotinylated hK2 followed by streptavidin-conjugated PE, with the results shown in FIG. 17. CAR expression in transduced JNL cells was confirmed for all of the selected clones with 60-75% of cells showing detectable expression across the different clones and parental 11B6 CARs. JNL cells containing the indicated CAR clones and un-transduced JNL cells (UTD) were co-cultured with target cells lines (VCap or DU145 cells) and luciferase activity was measured as luminescence intensity. Clones were considered active when the luminescence intensity exceeded 1.5-fold the level of UTD cells in the presence of antigen-expressing cells.

Figure 18:
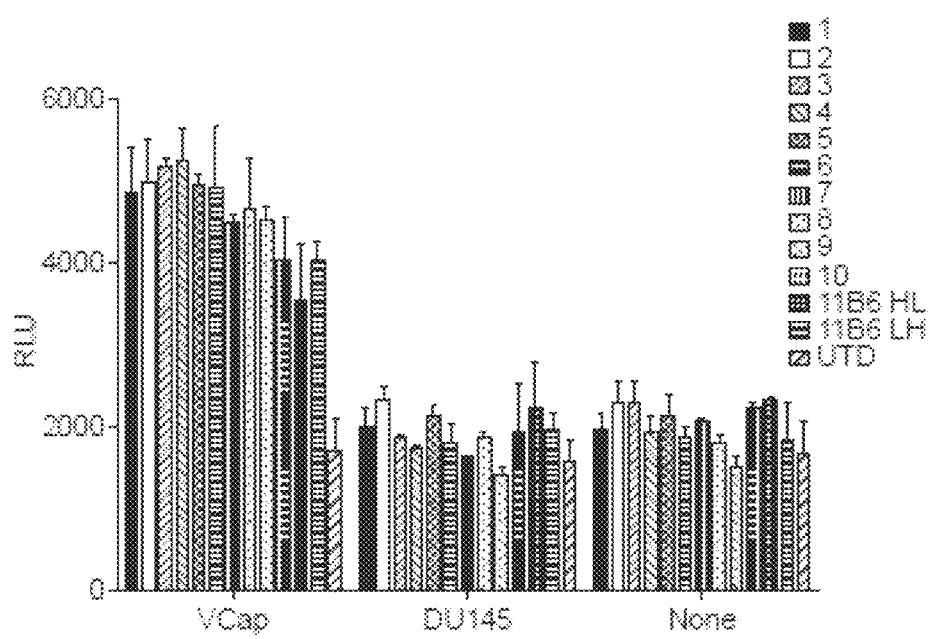
FIG. 18 shows binding between the CAR1-0 constructs and its cognate cellular antigen (hK2 on target cells) detected by luciferase expression in the JNL cells upon binding. JNL cells transduced with the indicated CAR constructs (CAR1-10) and un-transduced JNL cells (UTD) were co-cultured with target cells lines (VCaP or DU145 cells) and luciferase activity was measured as luminescence intensity. Constructs were considered active when the luminescence intensity exceeded 1.5-fold the level of UTD cells in the presence of antigen-expressing cells.
Figure 19:
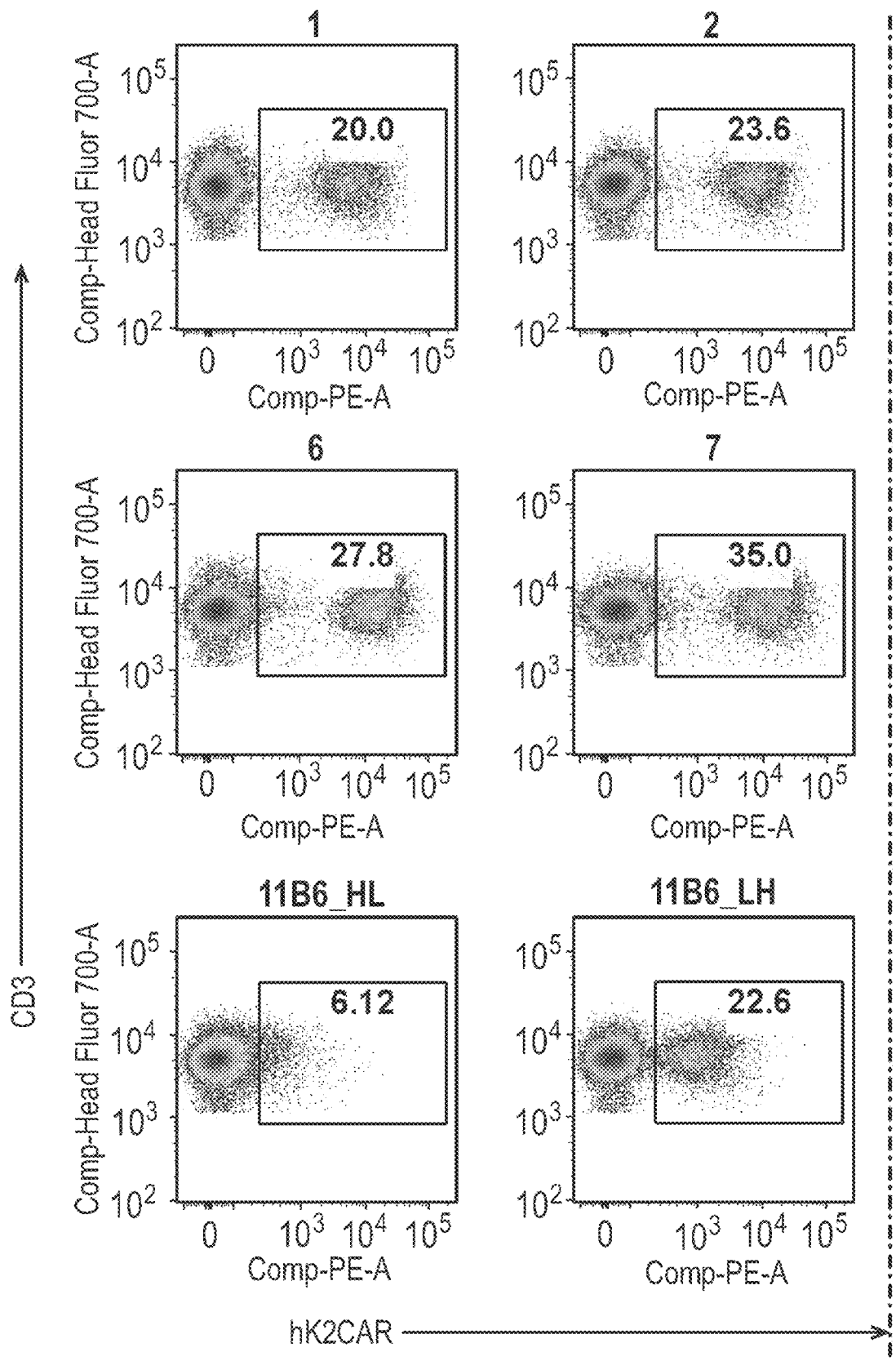
FIG. 19 shows hK2 CAR1-10 or parental 11B6_HL and 11B6_LH expression on T cell surface. Primary human T cells were transduced with 11B6 thermally stabilized and parental scFv CAR lentivirus (multiplicity of infection (MOI): 3) and CAR expression was determined by biotinylated hK2 (1 µg/ml) followed by streptavidin-conjugated PE 14 days post transduction. UTD: untransduced control.

The binding between the CAR construct and its cognate cellular antigen (hK2 on target cells) lead to luciferase expression in the JNL cells (FIG. 18). JNL cells containing the indicated CAR clones and JNL cells (untransduced, hereinafter "UTD") were co-cultured with target cells lines (VCap or DU145 cells) and luciferase activity was measured as luminescence intensity. Clones were considered active when the luminescence intensity exceeded 1.5-fold the level of UTD cells in the presence of antigen-expressing cells. No antigen-dependent activation was found for all the 10 clones and parental 11B6 CAR HL and LH.

Example 10: Expression of the Additional scFvs CARs on T Cells

To evaluate the function of thermally stabilized 11B6 CARs T cells, 11B6 thermally stabilized and parental scFv transduced CAR-T cells were generated using lentiviral transduction. Primary human T cells were transduced with 11B6 thermally stabilized and parental scFvs CAR lentivirus with a multiplicity of infection (MOI) of 3. CAR expression was determined by biotinylated hK2 (1 µg/ml) followed by streptavidin-conjugated PE 14 days post transduction.

The experimental protocol was as follows.

Lentiviral packaging was undertaken. 14E6 Lenti-X™ 293T cells were seeded per 150 mm² round-bottomed Corning™ BioCoat™ Collagen I coated culture dish, and incubated at 37° C. overnight using DMEM+10% FBS medium.

With Lenti-X™ 293T cells at the ideal confluency of 80-85%, the following was prepared. Culture media was replaced with 21 ml 293T growth media. Lipofectamine 2000 was diluted at room temperature and equilibrated OptiMEM. Diluted Lipofectamine 2000 was added to mixed plasmids drop-wise, and mixed well. The mixture was incubated at room temperature for 25 minutes. The transfection mixture was added to Lenti-X 293T cells dropwise, with the plate gently swirled to mix. The mixture was incubated in a 37° C. incubator. Lentivirus was harvested 24 and 48 hours post transfection. The above reagents are summarized in the Table 42.

TABLE 42

| Reagents | Per 15 cm dish |
| --- | --- |
| pMDLg/p | 18 µg |
| pRSV.Rev | 18 µg |
| pMD2.G | 7 µg |
| Transfer (CAR) plasmid | 15 µg |
| OptiMEM | 1500 ul |

Lentiviral concentration was performed as follows. Lentivirus-containing supernatants were harvested and centrifuged at 500×g for 10 min if excessive 293T cells are floating around before filtering through 0.45 µm cellulose acetate filters. Supernatant was transferred to a sterile container, combined with ⅓ volume of Lenti-X Concentrator (Clontech, Cat. #631232), and mixed by gentle inversion. The mixture was incubated at 4° C. overnight. The sample was centrifuged at 1,500×g for 45 minutes at 4° C., with a white pellet visible after centrifugation. The supernatant was carefully removed without disturbing the pellet. Residual supernatants were removed with a pipette after a brief centrifugation at 1,500×g. The pellet was gently resuspended in ¹/₁₀ of the original volume using cold T cell growth. The virus was aliquoted in 200 µl and immediately stored at −80° C.

Viral titering was performed as follows. Log-phase SupT1 was grown in complete RPMI. 100 µl 20,000 SupT1 cells/ml were seeded per well in a flat 96-well plate. Virus titration was then performed in 96-well round bottom plates). 100 µl media was added to all the wells in the plate. A virus aliquot was thawed from −80° C. freezer with one's hands. The aliquot was pipetted up and down to mix well, with 50 µl virus added to the first well, followed by thorough mixing. A serial 1:3 dilution was performed by pipetting 50 µl virus to the next well. Then. 50 µl media was added to primary Ab only, secondary Ab only, and un-transduced controls. 50 µl of each was transferred from the titration plate to 100 µl SupT1 cells in the assay plate with a multi-channel pipette, and incubated at 37° C. overnight. 100 µl of pre-warmed media was added to each sample, and incubated another two days. The transduction efficiency was determined by flow cytometry. Samples were transferred to a round bottom 96 well plate and spun at 1400 RPM for 3 minutes. The supernatant was discarded quickly, followed by blotting to remove excessive media in the hood. The wash was repeated with 150 µl FACS buffer. A staining protocol appropriate for CAR constructs was then undertaken. Samples were resuspended in 150 µl FACS buffer before flow cytometry analysis.

Viral titer calculation: Titer=(% CAR positive/100)×2×104×20×dilution factor

To exclude multiple copy integrations, titers with the closest transduction to 20% is used.

T-cell activation, transduction and expansion was performed as follows. A vial of naïve T cells was thawed in a water bath and added drop-wise to a 15 ml conical tube containing 9 ml of pre-warmed T-cell media (TCM CTS OpTmizer T Cell Expansion SFM+5% human serum+IL-2 100 IU/ml). The cryovial was washed with 1 ml of media to recover maximum number, and spun at 300×g for 8 minutes at room temperature. The pellet was resuspended in fresh 10 ml TCM, counted, and resuspended to 1E6 cells per milliner. 5E5 cells were added per well in 24-well plate. $1.5 \times 10^6$ CD3/CD28 beads were added per well in 500 µl volume such that the total volume was 1 ml per well. Twenty-four hours post activation, virus was thawed at room temperature. Virus was added at a multiplicity of infection (MOI) of 3, gently swirled to mix, and returned to the plate at the incubator. (The lentiviral functional titer was previously determined with SupT1 titer assay.) One well was reserved for Untransduced (UTD) in which is no virus added.

Twenty four hours post-transduction, 1 ml TCM was added to each well. Penicillin-Streptomycin was added from this point onward (Day 2). On days 3-5, 4 ml TCM was added for each 2 ml of cells and transferred to a T25 tissue culture treated flask. The flasks were placed horizontally in the incubator (Day 3). Equal volume of TCM was added for T-cell culture (Day 4). On days 5-14, the cells were checked every other day, with the viability, size and total cell count recorded. The cell density was adjusted to one million cells per mL. The ideal time of harvest is donor dependent, and determined by the cell size and the fold of expansion. Cells were generally frozen when the cell size was less than 8 µm based on the MOXI flow cell counter with the 100 to 200-fold of expansion.

Lentiviral transduction efficiency was checked on harvest day as follows. Cultures were mixed well. 100 µl of T-cells was harvested to a corresponding well in 96-well plate with 100 µl FACS Buffer, mixed, and spun at 1300 RPM for 3 minutes at room temperature. The cells were resuspended in 200 µl FACS buffer and centrifugation repeated at 4° C.

14 days post-transduction, the cells were resuspended in 100 µl of Biotin labeled hK2 (1 µg/ml diluted in FACS buffer) and incubated on ice for 30 minutes. 100 µl of FACS buffer was added, and spun washed at 4° C. The spin wash was repeated after adding another 200 µl FACS buffer. Staining with 100 µl of master solution containing secondary antibody SA-PE (1:250), live dead fixable stain (1:500), αCD3, αCD4 and αCD8 antibodies was performed on ice for 30 minutes. 100 µl FACS buffer was added and spun wash at 4° C., discarded and re-suspended in 200 µl FACS buffer before spin washing at 4° C. The samples were resuspended in 100 µl FACS Buffer before analyzing by flow cytometry.

Figure 27:
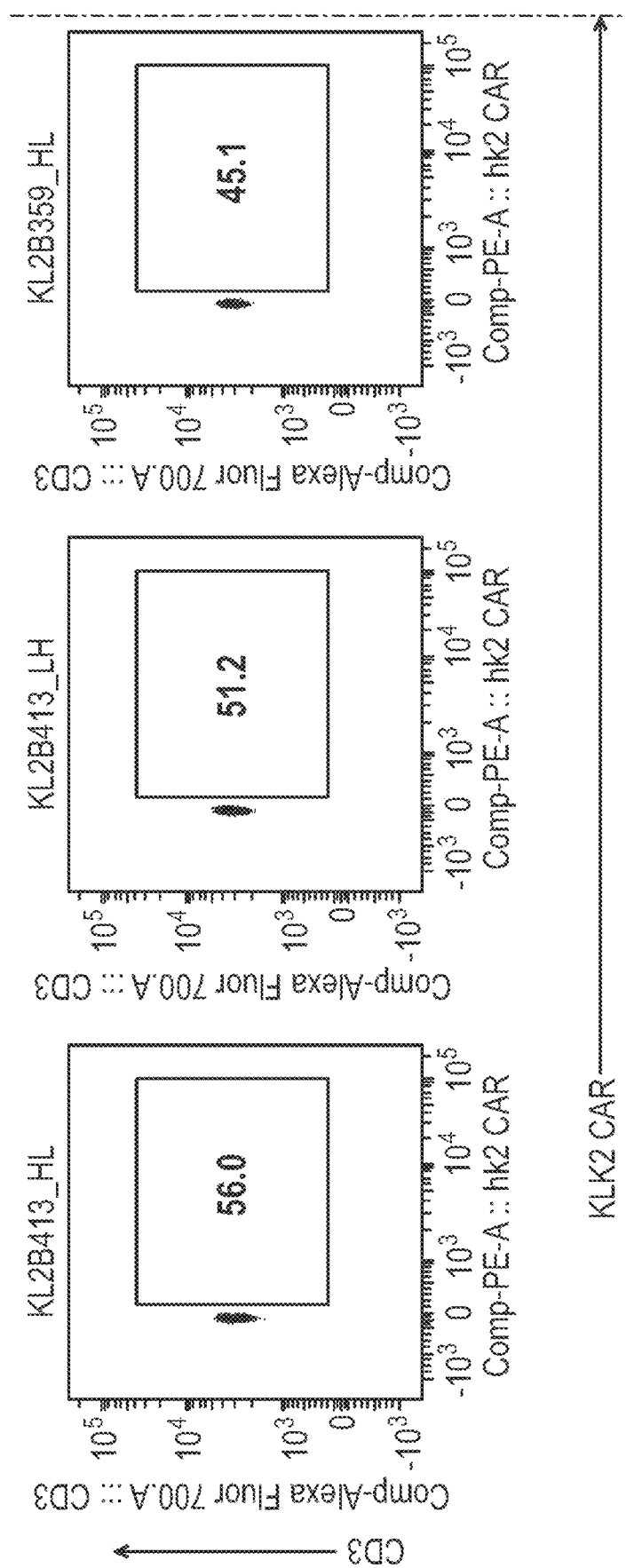
FIG. 27 shows the surface expression of CAR17 (KL2B413_HL), CAR18 (KL2B413_LH), CAR19 (KL2B359_HL) and CAR20 (HK2B359_LH on the surface of primary T cells. The numbers inside each histogram indicate the percentage of cells expressing the indicated CARs.
Figure 27:
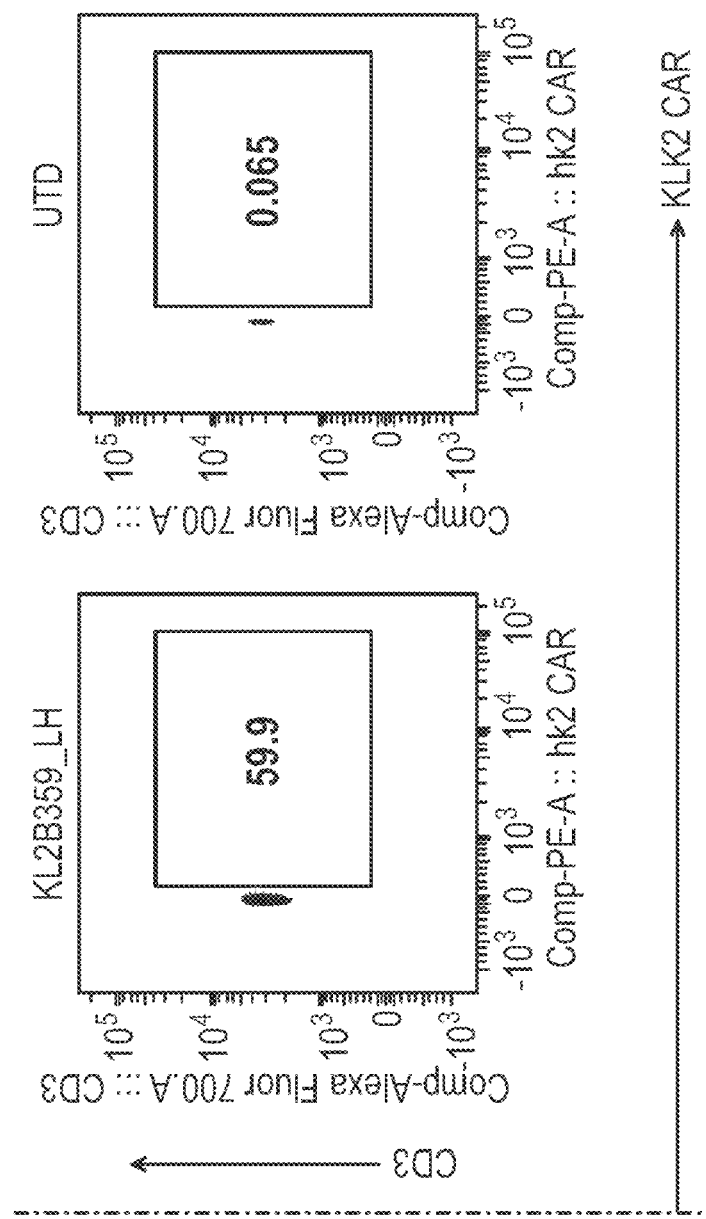

Cell harvest and freezing was performed as follows. The final cell count was determined. The culture was harvested and centrifuged at 300×g for 10 minutes at room temperature. The culture was resuspended in a smaller volume of media to fit in a 50 ml conical tube. The tubes were placed in magnets at 4° C. for 10 minutes to "de-bead". The cells were gently transferred from the tube to minimize disturbing the beads/magnet, and the exact volume recorded. Counting was repeated. Centrifugation was performed at 300×g for 10 minutes, with the supernatant discarded. Cells were frozen in CS-10 CryoStor® cell cryopreservation media in a cooling container. The containers were immediately transferred to −80° C. for 24-48 hours before permanent storage in liquid Nitrogen. The results are shown in FIG. 27, and confirmed hK2 CAR expression on the surface of the transduced T cells. Summary of the percentage of hK2 CAR+T cells (% positive) detected by each of the 10 thermally stabilized clones and parental 11B6 HL & LH analyzed were provided in the Figure. The results of the surface expression of CAR17 (KL2B413_HL), CAR18 (KL2B413_LH), CAR19 (KL2B359_HL) and CAR20 (HK2B359_LH) are shown in FIG. 27. As shown, different clones have different CAR expression level which ranged from 17.9% to 42.7%. The percentage of CAR positive CD3+ T cells was 56.0% for CAR17, 51.2% for CAR18, 45.1% for CAR19 and 59.9% for CAR20, and 0.065% s for untransduced cells (UTD in the Figure). All CAR T cells were normalized to the equal CAR+ T cells for subsequent functional assays.

Figure 20:
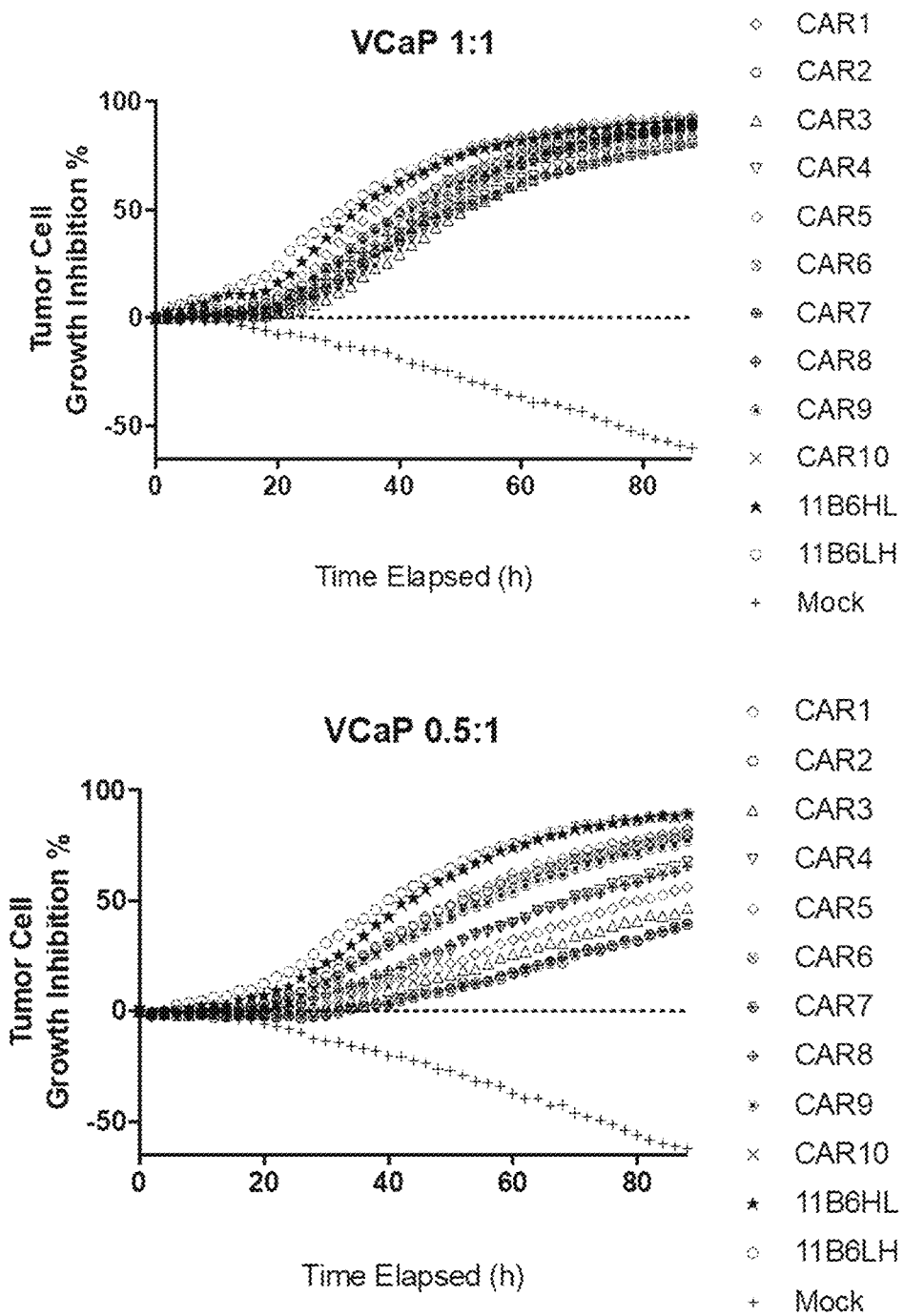
FIG. 20 shows percent tumor cell growth inhibition of hK2 positive VCaP cells at effector:target ratio of 1:1 or 0.5:1 by T cells transduced with CAR1-10 or the parental 11B6_HL or 11B6_LH. in the real-time IncuCyte killing assay assessing antigen-dependent cytotoxicity. Tumor cell growth inhibition (%)=(Initial Viable Target Cell Number–Current Viable Target Cell Number)/Initial Viable Cell Number*100(%).
Figure 21:
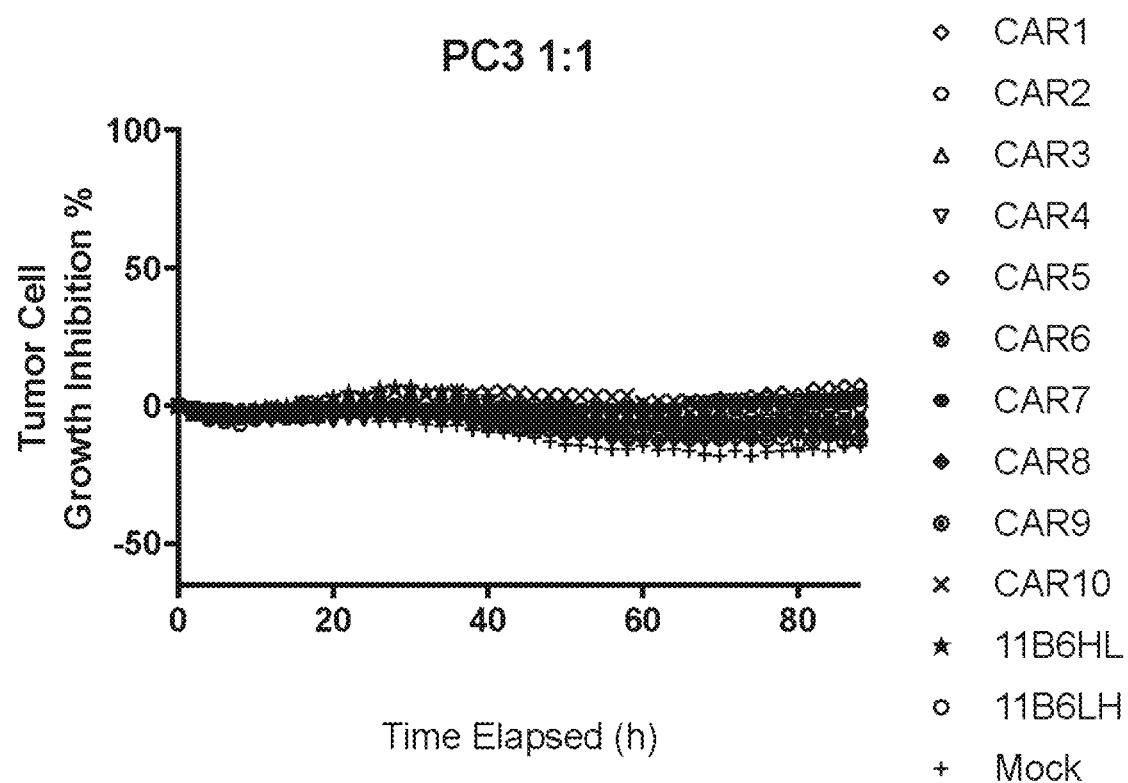
FIG. 21 shows percent tumor cell growth inhibition of PC3 cells at effector:target ratio of 1:1 by T cells transduced with CAR1-10 or the parental 11B6_HL or 11B6_LH. in the real-time IncuCyte killing assay assessing antigen-dependent cytotoxicity. Tumor cell growth inhibition (%)=(Initial Viable Target Cell Number–Current Viable Target Cell Number)/Initial Viable Cell Number*100(%).
Figure 30:
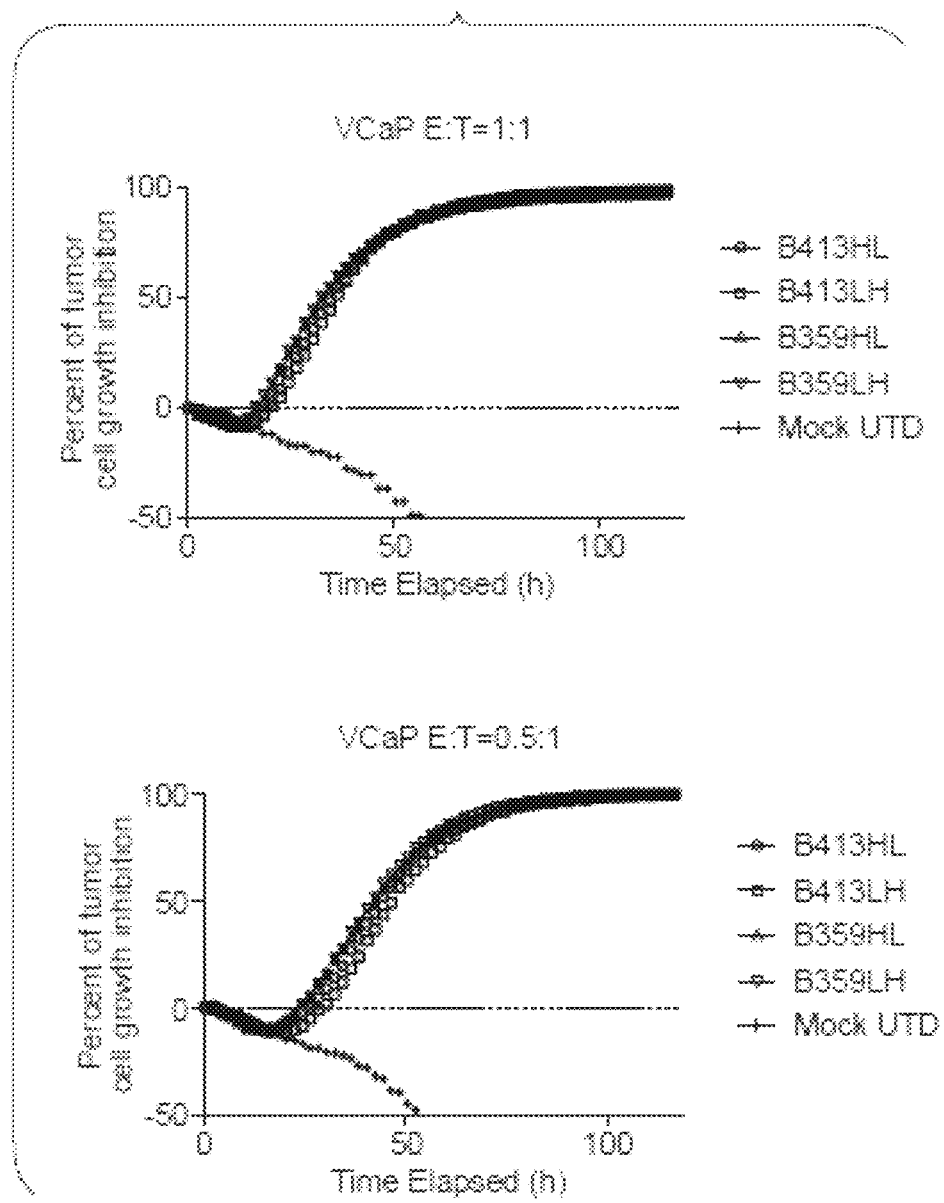
FIG. 30 shows percent tumor cell growth inhibition of hK2 positive VCaP cells by CAR-T cells transduced with CAR17 (B413HL in the Figure), CAR18 (B413LH in the Figure), CAR19 (B359HL in the Figure) and CAR20 (B359LH in the Figure) in the real-time IncuCyte killing assay assessing antigen-dependent cytotoxicity. Tumor cell growth inhibition (%)=(Initial Viable Target Cell Number–Current Viable Target Cell Number)/Initial Viable Cell Number*100(%).
Figure 31:
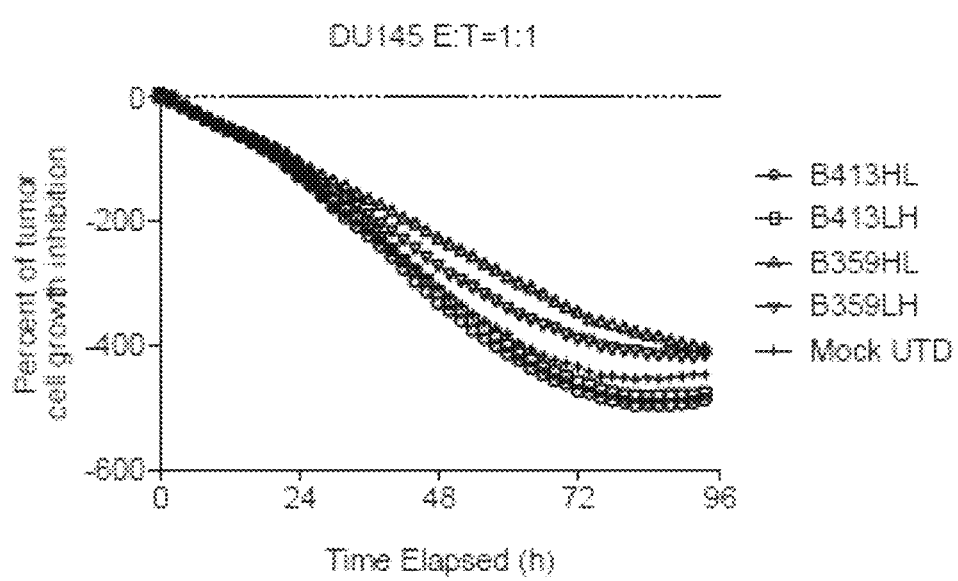
FIG. 31 shows percent tumor cell growth inhibition of hK2 negative DU145 cells by CAR-T cells transduced with CAR17 (B413HL in the Figure), CAR18 (B413LH in the Figure), CAR19 (B359HL in the Figure) and CAR20 (B359LH in the Figure) in the real-time IncuCyte killing assay assessing antigen-dependent cytotoxicity. Tumor cell growth inhibition (%)=(Initial Viable Target Cell Number–Current Viable Target Cell Number)/Initial Viable Cell Number*100(%).

Example 11: CAR-T Cells Mediate Tumor Cell Killing scFv CAR-T cells were evaluated in the real-time IncuCyte tumor killing assay for antigen-dependent cytotoxicity. Thermally stabilized hK2 CAR-T cells and parental 11B6 CAR-T cells were co-incubated with VCaP cells (FIG. 20) or PC3 cells (FIG. 21) for 88 hours at effector:target ratio of 1:1 or 0.5:1 which was calculated based on CAR expression data. CAR-T cells transduced with CAR17, CAR18, CAR19 and CAR20 were co-incubated with hK2 positive VCaP cells and hK2 negative DU145 cells for 96 hours at effector-to-target (ET) ratio of 1:1 or 0.5:1 which was calculated based on CAR expression on T cells. The percent tumor cell growth inhibition over time of CAR-T cells transduced with CAR17, CAR18, CAR19 and CAR20 is shown in FIG. 30 for VCap cells and in FIG. 31 for DU145 cells. Target cells were stably expressing a red nuclear dye which was measured by IncuCyte imaging system in a real-time fashion. Tumor cell growth inhibition (%)=(Initial Viable Target Cell Number−Current Viable Target Cell Number)/Initial Viable Cell Number*100(%). Tested CAR-T cells achieved approximately 100% TGI whereas the untransduced control did not demonstrate any TGI. No TGI was observed with the tested CAR-T cells in hK2 negative DU145 cells.

Example 12: Cytokine Production by Thermally Stabilized scFv CAR-T Cells

Supernatant was collected from overnight (approximately 20 hours) co-culture of hK2 CAR-T cells with VCaP cells at 1:1 of E/T ratio and was analyzed using 13-plex Milliplex Human High Sensitivity T cell kit (HSTCMAG28SPMX13). hK2 CAR modified T cells secreted cytokines during co-culture with hK2-expressing VCap cells, but minimal for un-transduced T cells (UTD). The results of cytokine release by hK2 CAR-T cells are shown in FIG. 22.

Figure 23:
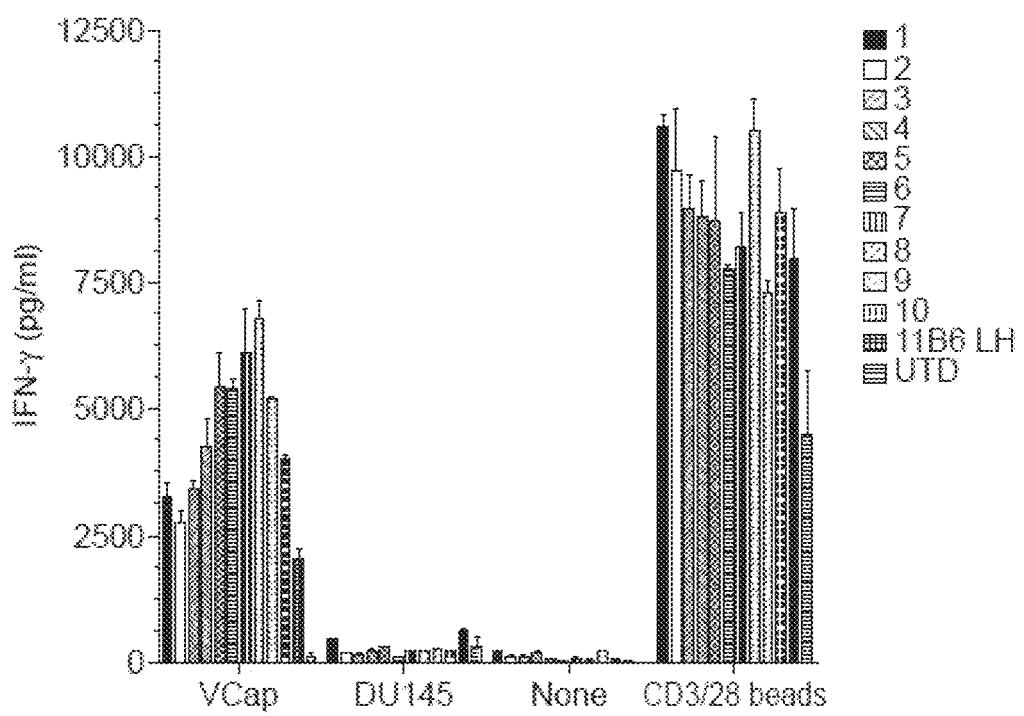
FIG. 23 shows IFN-γ release by hK2 CAR-T cells. Supernatant collected from overnight (approximately 20 hours) co-culture of hK2 CAR-T cells with VCap, DU145 (5E4 cells) cells at 1:1 of E/T ratio. hK2 CAR modified T cells secrete IFN-γ during co-culture with hK2-expressing VCaP cells, but not hK2-negative DU145 cells. Mean IFN-γ concentration±standard deviation (pg/ml) from duplicate cultures is shown. CD3/28 beads stimulated T cells and T cells only were used as positive and negative controls, respectively.
Figure 24B:
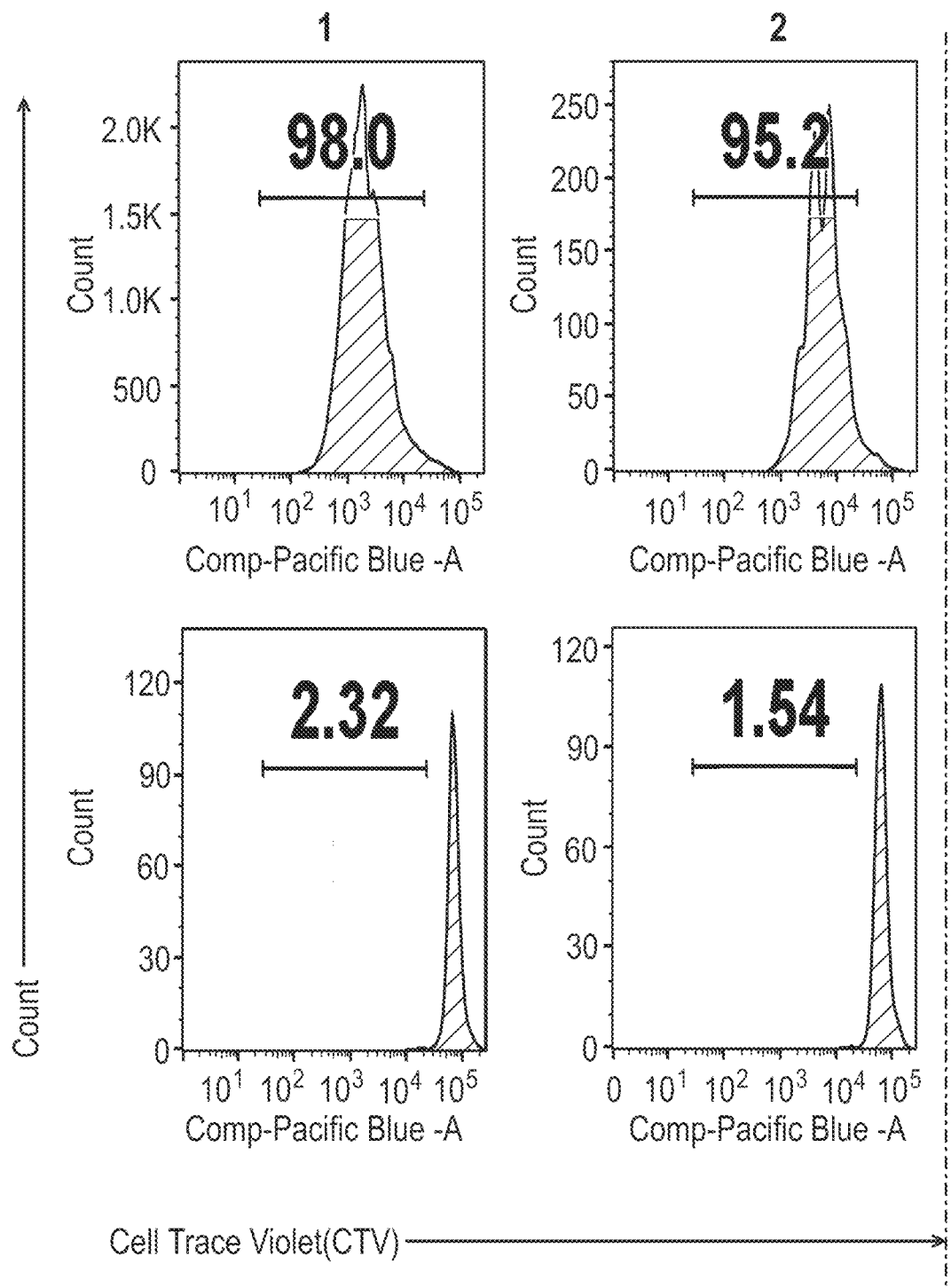
Figure 25A:
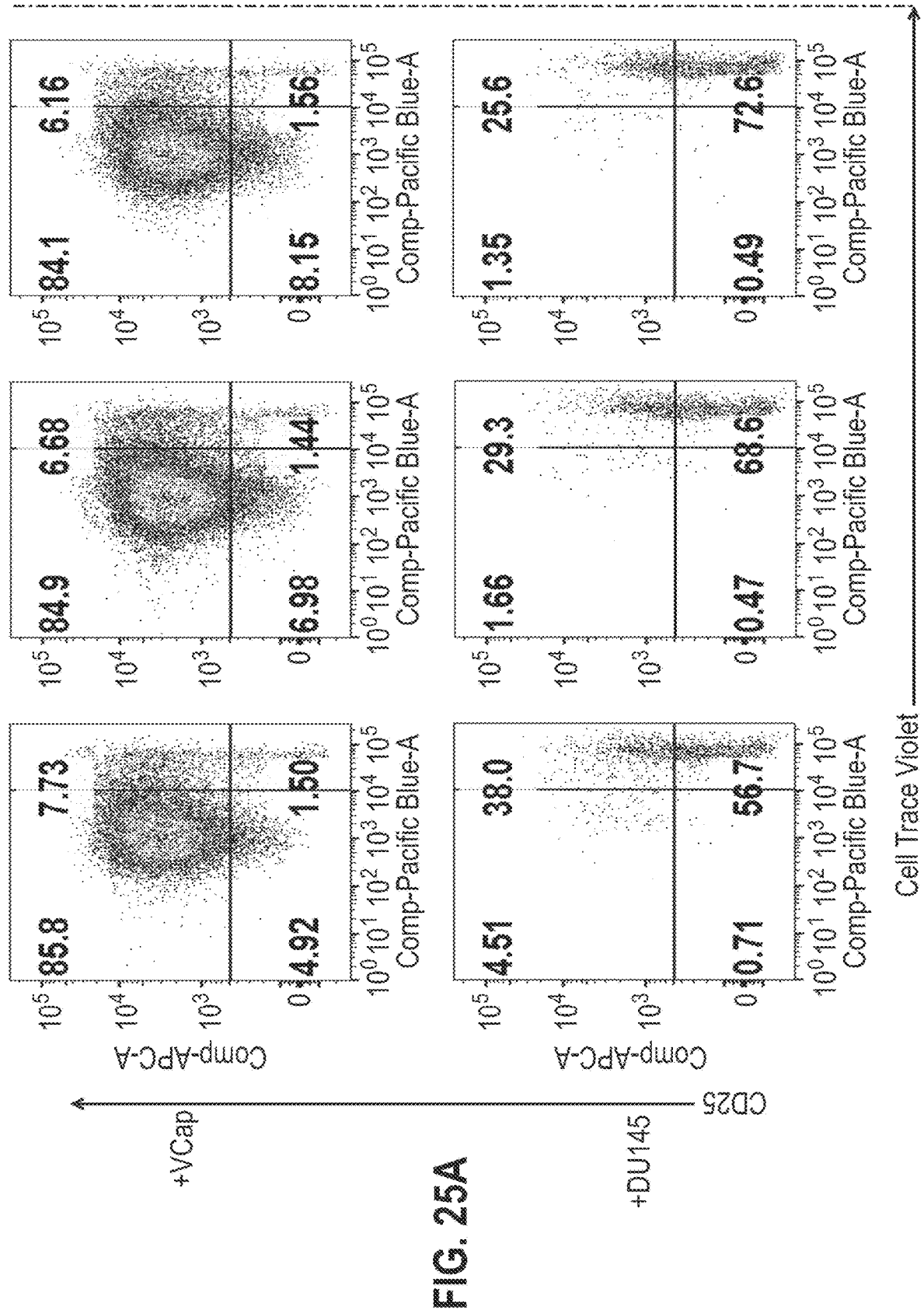
FIGS. 25A and 25B shows flow cytometry histograms of CD25 positive CellTrace Violet (CTV) labeled untransduced T cells (T cells only in the Figure) or CAR1-10-transduced CAR-T after 5-day co-culture with VCaP or DU145 cells, or after stimulation with CD3/28 beads.
Figure 25B:
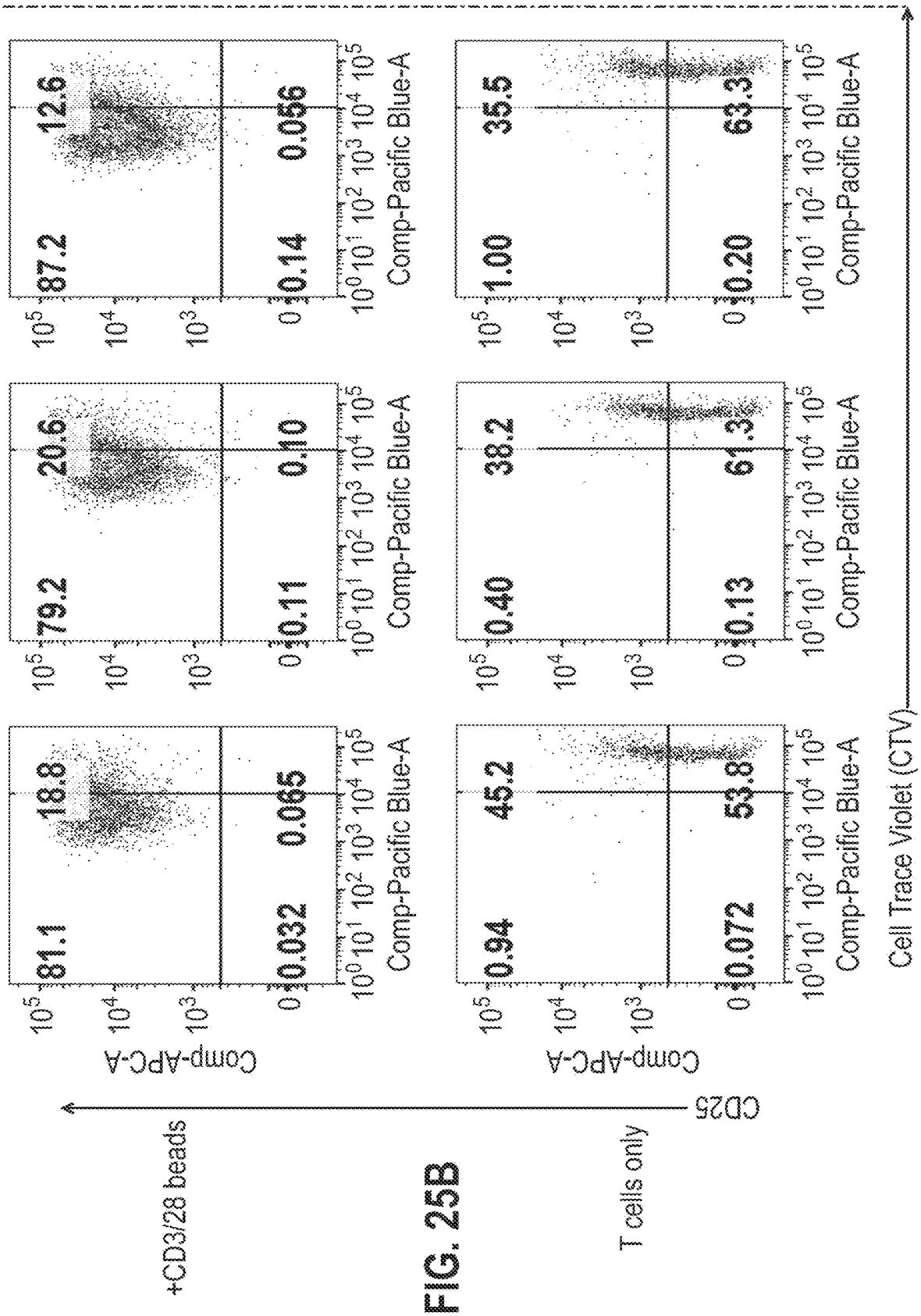
Figure 26:
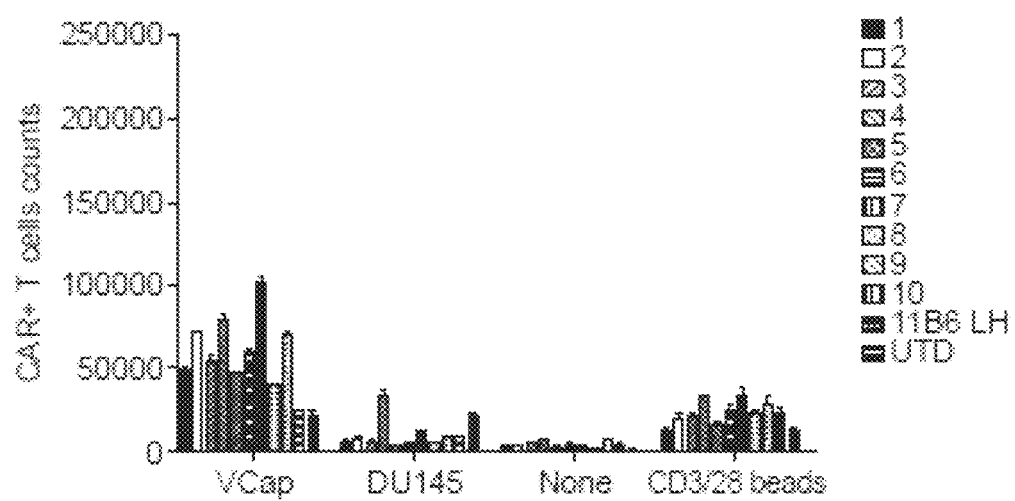
FIG. 26 shows that hK2 CAR-T cells proliferated more robustly than CD3/28 beads positive control after 5 days of coculture with VCaP cells. Different CAR constructs engineered T cells had different proliferation activity and displayed different CAR+ T cells counts. The CAR+ T cells counts were based on mean absolute cell count+/−SEM from three technical replicates.

Supernatant was collected from overnight (approximately 20 hours) co-culture of hK2 CAR-T cells with VCap, DU145 (5E4 cells) cells at 1:1 of E/T ratio. hK2 CAR-T cells secreted IFN-γ during co-culture with hK2-expressing VCap cells, but not during co-culture with hK2-negative DU145 cells. CD3/28 beads stimulated T cells and T cells only were used as positive and negative controls, respectively. IFN-γ release by hK2 CAR-T cells is shown in FIG. 23. Mean IFN-γ concentration±SD (pg/ml) from duplicate cultures is shown. Different thermally stabilized CAR-T cells produced different amount of IFN-γ when co-culture with hK2 (+) VCap cells.

Figure 34A:
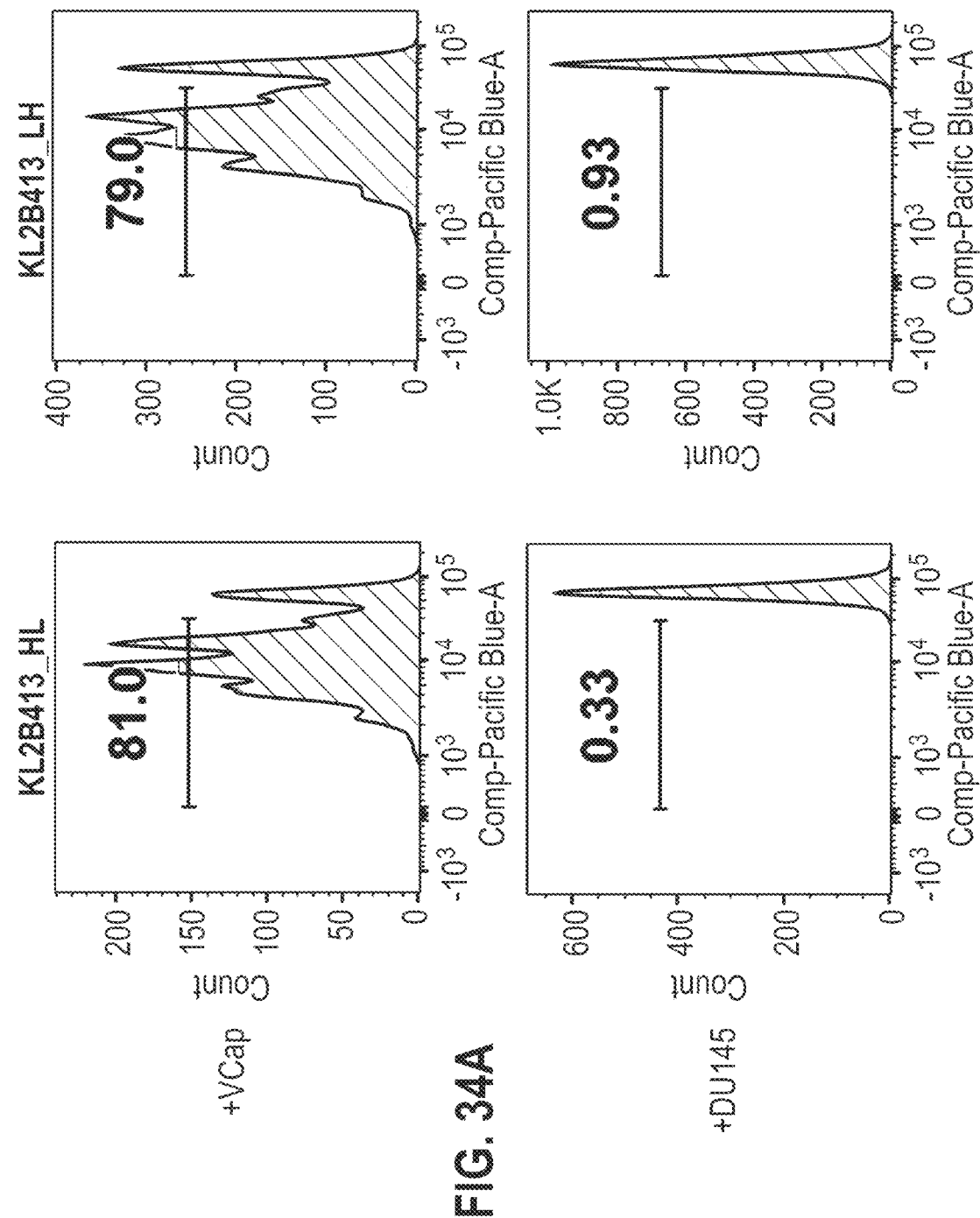
Figure 35:
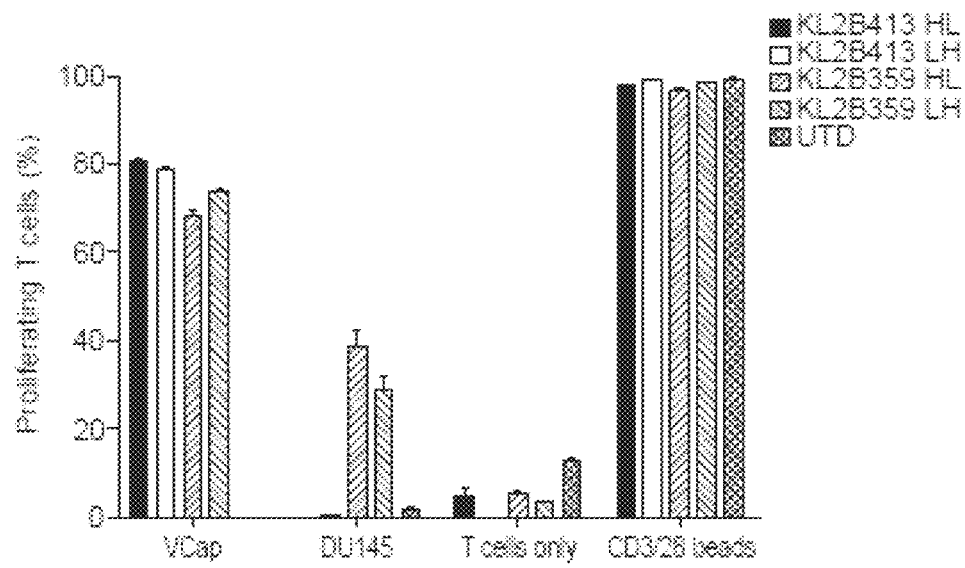
FIG. 35 shows the percentage of proliferating cells in co-cultures of CellTrace Violet (CTV) labeled untransduced T cells (T cells only in the Figure) or CAR-T cells transduced with CAR17 (KLB413HL in the Figure), CAR18 (KLB413LH in the Figure), CAR19 (KLB359HL in the Figure) and CAR20 (KLB359LH in the Figure) after 5-day co-culture with VCAP or DU145 cells. UTD: untransduced.

Example 13: Proliferation of hK2 CAR-T Cells hK2 CAR-T cells were evaluated in a proliferation assay. T-cell proliferation is an important in vitro parameter of in vivo immune function. To further evaluate the function of thermally stabilized 11B6 CAR-T cells, 11B6 thermally stabilized and parental scFvs CAR-T cells were labeled with CTV to assess T cells proliferation.

hK2 CAR-T and un-transduced (UTD) T cells were labelled with CellTrace Violet (CTV; 5 μM) and co-cultured with hK2 (+) VCap and hK2 (−) DU145 cells. Five days post co-culture, cells were harvested and stained with CD3, CD25, NearIR live/dead Dye and hK2 CAR. Flow cytometric analysis was performed on a Fortessa flow cytometer with Flowjo software. Lymphocytes were identified by live CD3, and the frequencies of CAR-T cells with CTV dye dilution and activation marker CD25 were determined. By gating on hK2 CAR+ T cells, as shown, the hK2(+) Vcap cells but not hK2(−) DU145 cells promoted the all CAR constructs engineered T cells proliferation (FIG. 33) and upregulation of activation marker CD25 (FIG. 34). CD3/28 beads stimulated T cells and T cells only were used as positive and negative controls, respectively. T cells only without any stimulation did not proliferate and CD3/28 beads stimulated T cells displayed equivalent proliferation pattern. As shown in FIG. 35, hK2 CAR-T cells proliferated more robustly than CD3/28 beads positive control after 5 days of co-culture with VCap cells. Different CAR constructs engineered T cells have different proliferation activity and displayed different CAR-T cells counts. The CAR-T cells counts based on mean absolute cell count+/−SEM from three technical replicates.

The protocol was as follows. The tumor cells Vcap and DU145 were collected, washed twice with PBS, and resuspended in 10E6/ml in PBS containing 100 ug/ml Mitomycin C (MMC) for 1.5 hours in a 37° C. incubator so as to block tumor cells proliferation. 20 μL of DMSO was added to a vial of CTV staining solution. 5 μl of the solution was diluted into 5 mL (1:1000) PBS (warmed to 37° C.) to provide a 5 μM staining solution. The 2E6 T cells were counted, collected, washed with PBS twice, and resuspended in 4E6/ml (0.5 ml). An equal volume (0.5 ml) of CTV staining solution was added. The cells were incubated for 20 minutes at 37° C. Then, 4 ml PRMI+20% FBS was added to the cells to absorb any unbound dye. The cells were incubated for 5 minutes, and centrifuged for 5 minutes at 400×g. The cell pellet was resuspended in pre-warmed RPMI+10% FBS medium. The T cells were counted, and 1E5 cells (100 ul) were seeded in 96-wells flat bottom-plate.

In the meantime, MMC-treated tumor cells hK2(+) VCap and HK2(−) DU145 were collected and counted after 1.5 hours, and then resuspended at 1E6/ml. 1E5 of the cells (100 μl) were cocultured with T cells in a 96-well plate. T cells alone, and T cells added 3:1 CD3/28 beads to cells ratio, were used as negative and positive controls, respectively.

After 5 days of co-culture, all of the cells were collected from each well. The cells were centrifuged and washed for 5 minutes at 400×g twice, then stained hK2CAR, CD3, CD8 and CD25, live/dead (Near-IR) in 96-well U bottom plate. After washing, all cells were fixed for 10 minutes using 100 μl BD Cytofix™ Fixation Buffer (50 ul FACS buffer+50 ul Fixation Buffer). The stained samples were analyzed by multicolor flow cytometry after the end of the incubation period.

Data analysis was performed as follows. A CTV histogram was prepared. The CTV undiluted gate was set to encompass the far-right peak (CTV bright) of T cells cultured alone, and the CTV diluted gate to capture the rest of the population. This was applied to all samples.

Example 14. Characterization of CAR-T Cells Transduced with CAR17, CAR18, CAR19 or CAR20

Activation of CAR-T Cells is Antigen-Dependent

Figure 28:
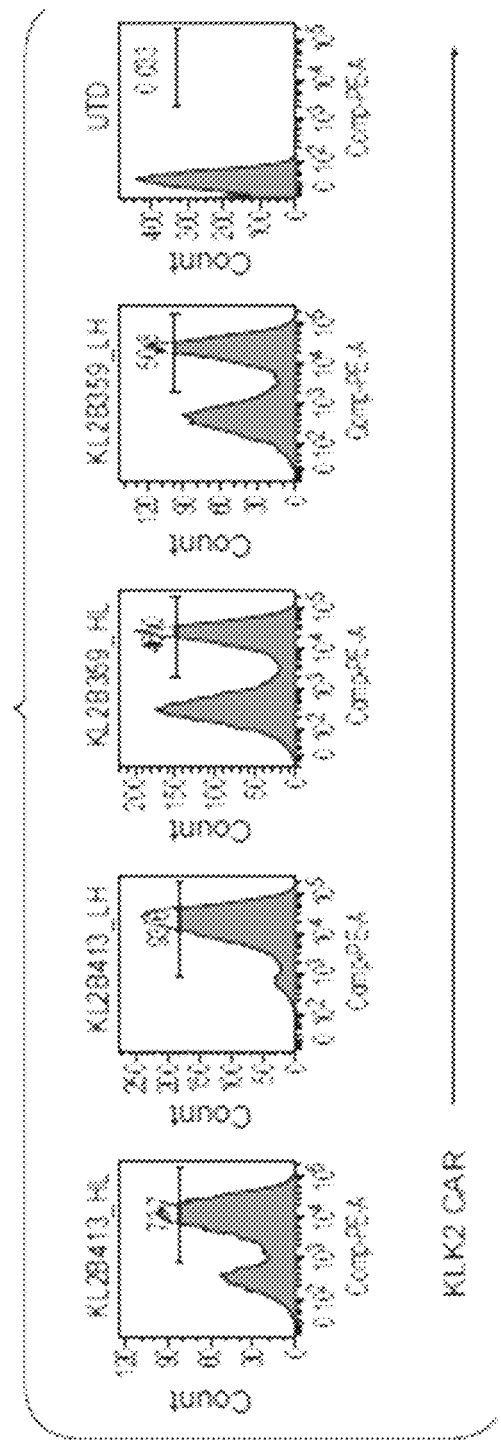
FIG. 28 shows the surface expression of CAR17 (KL2B413_HL), CAR18 (KL2B413_LH), CAR19 (KL2B359_HL) and CAR20 (KL2B359_LH) on JNL cells.

The generated CAR-T cells were evaluated in the JNL reporter assay for antigen-dependent activity as described in Example 5. Briefly, Jurkat cells containing the luciferase gene driven by the signaling-responsive NFAT promoter (termed JNL cells) were transduced with CAR17 (KL2B413_HL), CAR18 (KL2B413_LH), CAR19 (KL2B359_HL) or CAR20 (KL2B359_LH) constructs. Expression of each CAR was determined by biotinylated hK2 followed by streptavidin-conjugated PE. CAR expression in transduced JNL cells was confirmed for the selected clones with 46-50% of cells expressing KL2B359-based CARs and 73.7-96% of cells expressing KL2B413-based CARs as shown in FIG. 28. The percent JNL cells expressing each CAR was following: CAR17 (KL2B413_HL): 73.7%. CAR18 (KL2B413_LH): 93.6%, CAR19 (KL2B359_HL): 46%, CAR20 (KL2B359_LH): 50.8%.

Figure 29:
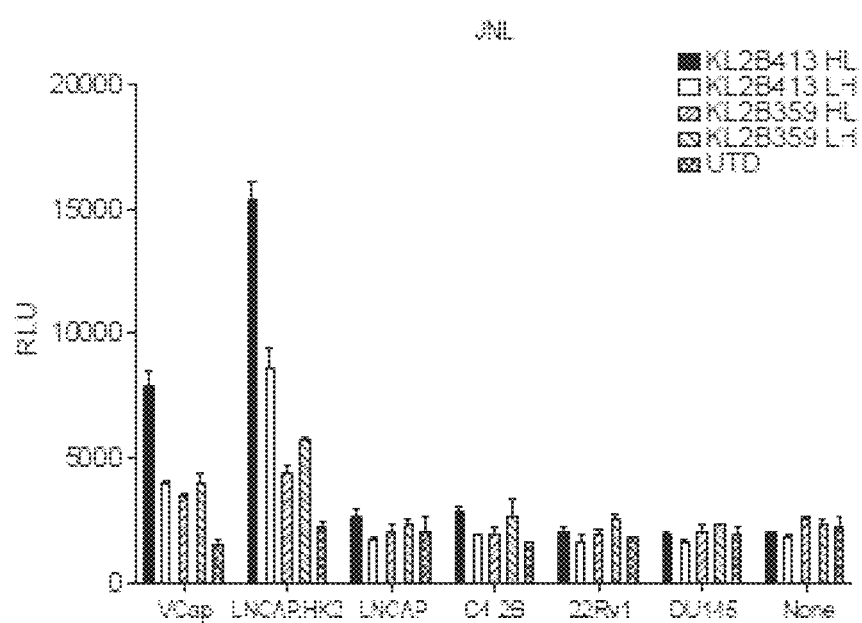
FIG. 29 shows the relative light units (RLU) resulting from luciferase expression in JNL cells mediated by binding of the test CAR-T to its cognate receptor on various target cells as indicated in the Figure. JNL cells containing the indicated CAR clones and untransduced JNL cells (UTD) were co-cultured with target cells lines (VCaP, LNCaP/hK2, LNCaP, C4-2B, 22Rv1 or DU145 cells) and luciferase activity was measured as luminescence intensity (RLU, relative light units). KL2B413_HL: CAR17, KL2B413_LH: CAR18, HL2B359_HL: CAR19, KL2B359_LH: CAR20.

Binding between the hK2 CAR construct and its cognate cellular antigen (hK2 on target cells) leads to luciferase expression in the JNL cells. To that end, JNL cells transduced with the test CAR constructs or untransduced JNL cells (UTD) were co-cultured with target cells lines (VCap, LNCap/hK2 (LNCaP cells recombinantly expressing hK2), LNCaP, C4-2B, 22Rv1 or DU145 cells) and luciferase activity was measured as luminescence intensity. Constructs were considered active when the luminescence intensity exceeded 1.5-fold the level of UTD cells in the presence of antigen-expressing cells. No antigen-dependent activation was found for the tested CAR constructs. FIG. 29 shows the RLU (relative light units) resulting from binding of CAR-T cells to test target cells ad indicated in the Figure.

CAR-T Cells Mediate Tumor Cell Killing in Antigen-Dependent Manner

CAR-T cells transduced with CAR17, CAR18, CAR19 and CAR20 were co-incubated with hK2 positive VCaP cells and hK2 negative DU145 cells for 96 hours at effector-to-target (ET) ratio of 1:1 or 0.5:1 which was calculated based on CAR expression on T cells (Example 11). Target cells were stably expressing a red nuclear dye, which was measured by IncuCyte imaging system in a real-time fashion. The percent tumor cell growth inhibition over time is shown in FIG. 30 for VCap cells and in FIG. 31 for DU145 cells. Tumor cell growth inhibition (TGI) (%)=(Initial Viable Target Cell Number−Current Viable Target Cell Number)/Initial Viable Cell Number*100(%). Tested CAR-T cells achieved approximately 100% TGI whereas the untransduced control did not demonstrate any TGI. No TGI was observed with the tested CAR-T cells in hK2 negative DU145 cells.

CAR-T Cells Produce Cytokines Upon Antigen Stimulation

Figure 32:
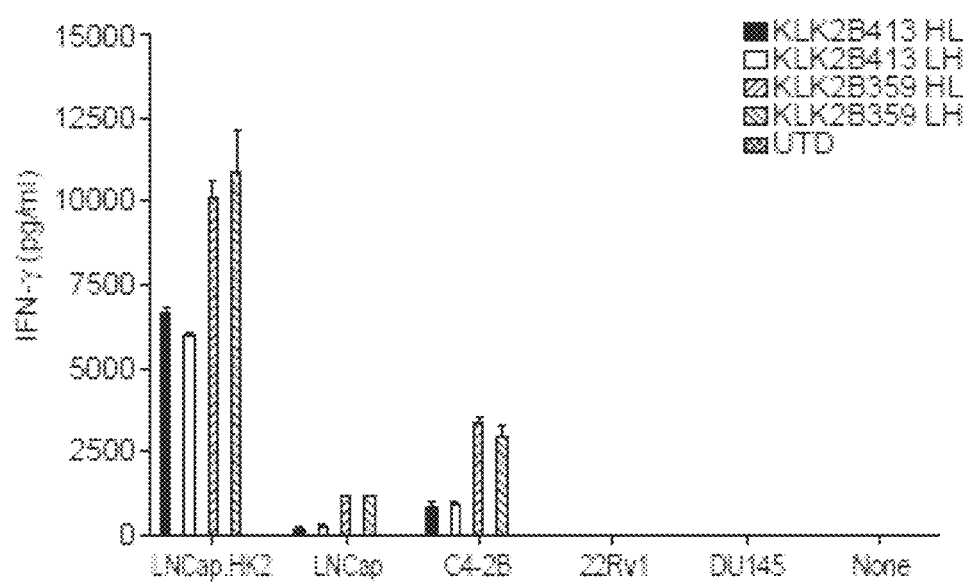
FIG. 32 shows IFN-γ production by CAR-T cells transduced with CAR17 (KLK2B413HL in the Figure), CAR18 (KLK2B413LH in the Figure), CAR19 (KLK2B359HL in the Figure) and CAR20 (KLK2B359LH in the Figure) or untransduced T cells (UTD) in co-cultures with cells indicated in the Figure.

IFN-γ produced by cytotoxic T cells is critical for exerting immune surveillance of tumors, which can directly inhibit proliferation and induce apoptosis of some malignancies in vivo and in vitro. To determine whether hK2 CAR-modified human T cells were able to recognize and become activated by hK2 positive tumor cells, primary T cells transduced with indicated CAR clones and control untransduced T cells (UTD) were co-cultured with target cells lines (LNCaP/hK2, LNCaP, C4-2B, 22Rv1 or DU145 cells) and supernatant were collected for IFN-γ concentration measurement. As shown in FIG. 32, CAR-T cells transduced with hK2 CARs cells secreted IFN-γ during co-culture with LNCaP cells recombinantly expressing hK2 (LNCap/hK2) cells and also during co-culture with very low hK2-expressing C4-2B and LNCap cells but not hK2-negative DU145 cells. Mean IFN-γ concentration±SD (pg/ml) from duplicate cultures is shown in the Figure.

CAR-T Cells are Activated and Upregulate Markers of Degranulation in Antigen-Dependent Manner Tumor cells can be recognized and killed by cytotoxic lymphocytes, such as CD8+ T lymphocytes and natural killer (NK) cells mainly through the immune secretion of lytic granules that kill the target tumor cells. This process involves the fusion of the granule membrane with the cytoplasmic membrane of the immune effector cell, resulting in surface exposure of lysosomal-associated proteins that are typically present on the lipid bilayer surrounding lytic granules, such as CD107a. Therefore, membrane expression of CD107a constitutes a marker of immune cell activation and cytotoxic degranulation.

The degranulation assay was performed as described below. Target cells ($5 \times 10^4$) were co-cultured with an equal number of effector cells in 0.1 ml per well in a 96-well plate. Control wells contained T cells alone. Anti-CD107a (5 μl per well) were added in addition to 1 μl/sample of monensin (BD Biosciences) and incubated for 4 hours at 37° C. Cells were washed two times with PBS, stained for expression of the hK2 CAR, CD3, and CD8 and analyzed on a flow cytometer BD Fortessa.

Figure 33A:
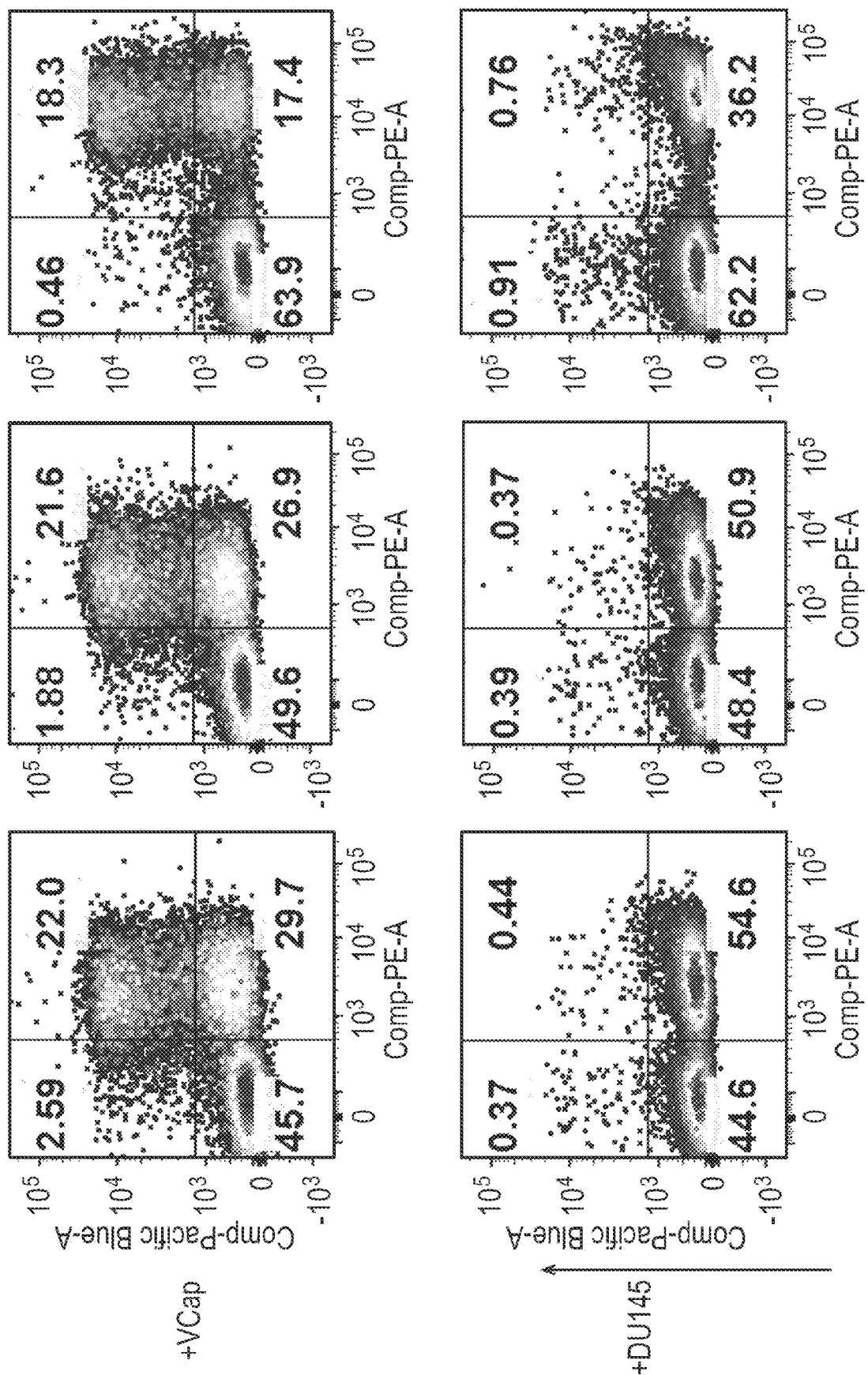
FIG. 33A and FIG. 33B show that co-culture of CAR-T cells transduced with CAR17 (B413HL in the Figure), CAR18 (B413LH in the Figure), CAR19 (B359HL in the Figure) and CAR20 (B359LH in the Figure) and VCap cells result in increase in CD107a+hK2-CAR-T+ cells, indicative of immune cell activation and cytotoxic degranulation, whereas co-culture with hK2 negative DU145 cells had no effect.
Figure 33B:
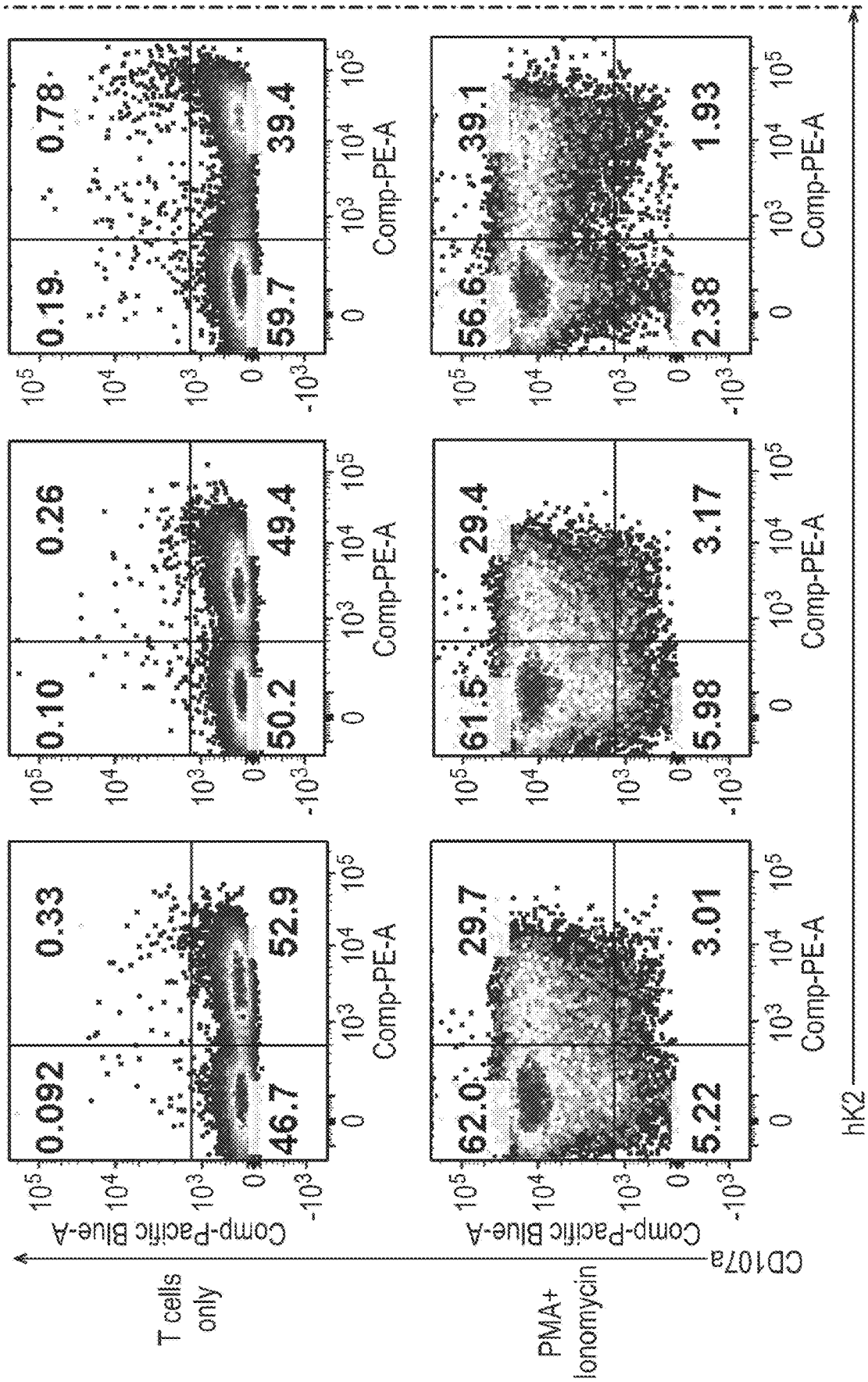

The results of the degranulation assay are shown in FIG. 33. An increase in CD107A+hK2 CAR-T cells was evident in co-cultures with hK2 positive Vcap cells, whereas co-culture with hK2 negative DU145 had no effect. Only background staining (<2%) was seen in the CAR-T cells only without tumor cells stimulation and in the UTD control. Phorbol 12-myristate 13-acetate (PMA) in combination with ionomycin (eBioscience™ Cell Stimulation Cocktail: 500×) was a consistent inducer of CD107a cell surface expression in this 4-hour cell culture model, which was used as a positive control. Results are shown for representative donor T cells and were reproducible in multiple donors.

CAR-T Cells Proliferate in Antigen-Dependent Manner

Figure 36A:
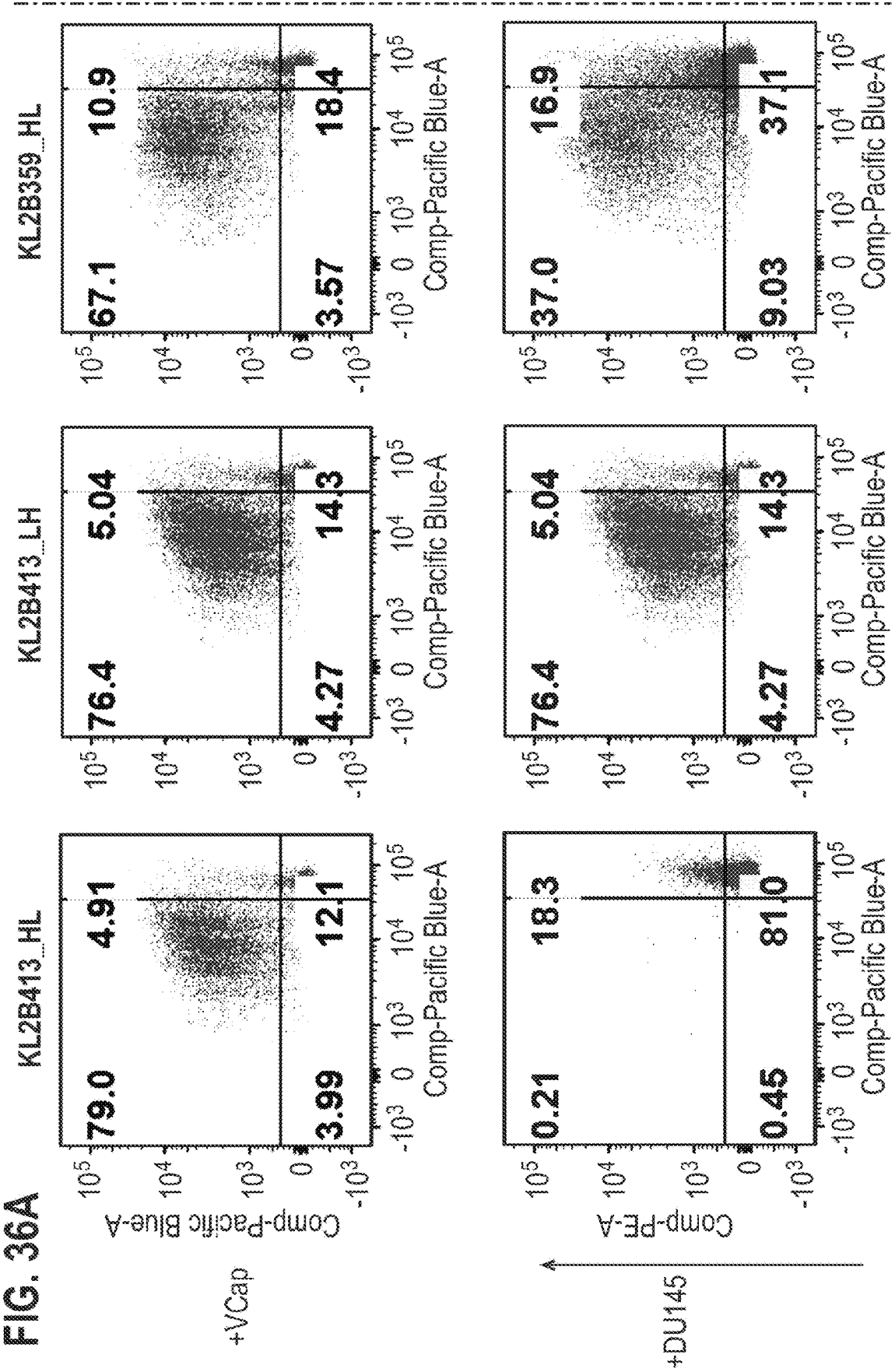
Figure 37:
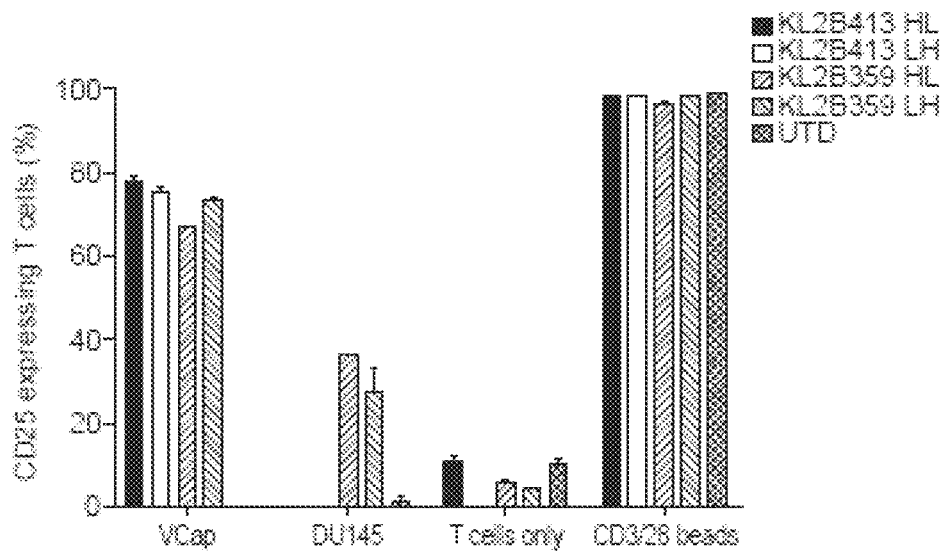
FIG. 37 shows the percentage of CTV expressing untransduced T cells (UTD) or CAR-T cells transduced with CAR17 (KLB413HL in the Figure), CAR18 (KLB413LH in the Figure), CAR19 (KLB359HL in the Figure) and CAR20 (KLB359LH in the Figure) after 5-day co-culture with VCaPs or DU145 cells, alone (T cells only) or after CD2/28 bead stimulation.

CAR-T cells were evaluated for their proliferation using T-cell proliferation assay protocol described in Example 9. hK2 CAR-T and untransduced (UTD) T cells were labelled with CellTrace Violet (CTV; 5 μM) and co-cultured with hK2 positive VCap and hK2 negative DU145 cells. Five days post co-culture, cells were harvested and stained with CD3, CD25, NearIR live/dead Dye and hK2 CAR. Flow cytometric analysis was performed on a Fortessa flow cytometer with Flowjo software. Lymphocytes were identified by live CD3, and the frequencies of CAR-T cells with CTV dye dilution and activation marker CD25 were determined. By gating on CD3+ T cells, the hK2 positive Vcap cells but not hK2 negative DU145 cells promoted proliferation of each tested CAR-T cell line, as shown in FIG. 34 and FIG. 35, and upregulation of activation marker CD25 as shown in FIG. 36 and FIG. 37. T cells only without any stimulation did not proliferate and CD3/28 beads stimulated T cells displayed equivalent proliferation pattern. hK2 CAR+ T cells proliferated more robustly than CD3/28 beads positive control after 5 days of coculture with VCap cells. Different tested CAR-T cells had different proliferation activity and displayed different CAR-T cells counts. The percentage of proliferating T cells and CD25 expressing T cells was based on mean absolute cell count +/−SEM from duplicate.

Example 15: Generation and Characterization of ADC

Antibodies or antigen binding domains that bind hK2 are be labeled with various radiometals such as In-111, Zr-89, or Lu-177 Ac-225 and in vivo tumor biodistribution or tumor efficacy is evaluated in established subcutaneous (SC) human prostate models including LNCaP, VCaP or C4-2B in male NOD.Cg-Prkdc$^{scid}$ Il2rg$^{tm1 Wjl}$/SzJ (NSG, The Jackson Laboratory, Bar Harbor, Me.) or in Balb-c or SHO Nude mice. Various doses of antibodies or antigen binding domains that bind hK2 or isotype control antibodies are labeled with different amounts of radioactivity (10-1000 nCi) and tumor uptake or efficacy is measured.

SEQUENCE LISTING (471 sequences)

SEQ ID NO: 1 - protein, 111 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 2 - protein, 111 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 3 - protein, 111 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 4 - protein, 117 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 5 - protein, 117 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 6 - protein, 117 aa, Artificial Sequence
  Description of Artificial Sequence: Synthetic polypeptide
QVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 7 - protein, 20 aa, Artificial Sequence
  Description of Artificial Sequence: Synthetic peptide
GGSEGKSSGSGSESKSTGGS

SEQ ID NO: 8 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 9 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 10 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 11 - protein, 248 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 12 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 13 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 14 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 15 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 16 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 17 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 18 - protein, 248 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 19 - protein, 248 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 20 - protein, 248 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 21 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 22 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 23 - protein, 248 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 24 - protein, 19 aa, Artificial Sequence
  Description of Artificial Sequence: Synthetic peptide
MAWVWTLLFLMAAAQSIQA

SEQ ID NO: 25 - protein, 45 aa, Artificial Sequence
  Description of Artificial Sequence: Synthetic polypeptide
TSTPAPRPPTPAPTIASQPLSLRPEACRPAAGGAVHTRGLDFACD

SEQ ID NO: 26 - protein, 24 aa, Artificial Sequence
  Description of Artificial Sequence: Synthetic peptide
IYIWAPLAGTCGVLLLSLVITLYC

SEQ ID NO: 27 - protein, 42 aa, Homo sapiens
KRGRKKLLYIFKQPFMRPVQTTQEEDGCSCRFPEEEEGGCEL

SEQ ID NO: 28 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 29 - protein, 267 aa, Artificial Sequence
  Description of Artificial Sequence: Synthetic polypeptide
MAWVWTLLFLMAAAQSIQAQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 30 - protein, 267 aa, Artificial Sequence
  Description of Artificial Sequence: Synthetic polypeptide
MAWVWTLLFLMAAAQSIQAQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 31 - protein, 267 aa, Artificial Sequence
  Description of Artificial Sequence: Synthetic polypeptide
MAWVWTLLFLMAAAQSIQAQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 32 - protein, 267 aa, Artificial Sequence
  Description of Artificial Sequence: Synthetic polypeptide
MAWVWTLLFLMAAAQSIQAQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 33 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 34 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 35 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 36 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 37 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSS

SEQ ID NO: 38 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSS

SEQ ID NO: 39 - protein, 267 aa, Artificial Sequence
  Description of Artificial Sequence: Synthetic polypeptide
MAWVWTLLFLMAAAQSIQAQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIK

SEQ ID NO: 40 - protein, 267 aa, Artificial Sequence
  Description of Artificial Sequence: Synthetic polypeptide
MAWVWTLLFLMAAAQSIQAQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIK

SEQ ID NO: 41 - protein, 267 aa, Artificial Sequence
  Description of Artificial Sequence: Synthetic polypeptide
MAWVWTLLFLMAAAQSIQAQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIK

SEQ ID NO: 42 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 43 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 44 - protein, 267 aa, Artificial Sequence
  Description of Artificial Sequence: Synthetic polypeptide
MAWVWTLLFLMAAAQSIQADIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSS

SEQ ID NO: 45 - protein, 154 aa, Artificial Sequence
  Description of Artificial Sequence: Synthetic polypeptide
KRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 46 - protein, 471 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 47 - protein, 471 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 48 - protein, 471 aa, Artificial Sequence
  Description of Artificial Sequence: Synthetic polypeptide
QVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 49 - protein, 471 aa, Artificial Sequence
  Description of Artificial Sequence: Synthetic polypeptide
QVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 50 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 51 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 52 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 53 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 54 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQFPGKGLEWMGYISYSGSTTYNPSLKSRVTISRDTSKNQFSLKLSSVTPVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 55 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQFPGKGLEWIGYISYSGSTTYNPSLKSRVTISRDTSKNQFSLKLSSVTPVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 56 - protein, 471 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 57 - protein, 471 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 58 - protein, 471 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSGGSEGKSSGSGSESKSTGGSDIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 59 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTIQSVQAEDVSVYFCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 60 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 61 - protein, 471 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSVQAEDVAVYYCQQTRKVPYTFGQGTKLEIKGGSEGKSSGSGSESKSTGGSQVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 62 - protein, 261 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 63 - protein, 6 aa, Artificial Sequence
  Description of Artificial Sequence: Synthetic peptide
SDYAWN

SEQ ID NO: 64 - protein, 16 aa, Artificial Sequence
  Description of Artificial Sequence: Synthetic peptide
YISYSGSTTYSPSLKS

SEQ ID NO: 65 - protein, 16 aa, Artificial Sequence
  Description of Artificial Sequence: Synthetic peptide
YISYSGSTTYNPSLKS

SEQ ID NO: 66 - protein, 8 aa, Artificial Sequence
  Description of Artificial Sequence: Synthetic peptide
GYYYGSGF

SEQ ID NO: 67 - protein, 15 aa, Artificial Sequence
  Description of Artificial Sequence: Synthetic peptide
RASESVEYFGTSLMH

SEQ ID NO: 68 - protein, 15 aa, Artificial Sequence
  Description of Artificial Sequence: Synthetic peptide
KASESVEYFGTSLMH

SEQ ID NO: 69 - protein, 7 aa, Artificial Sequence
  Description of Artificial Sequence: Synthetic peptide
AASNVES

SEQ ID NO: 70 - protein, 7 aa, Artificial Sequence
  Description of Artificial Sequence: Synthetic peptide
AASNRES

SEQ ID NO: 71 - protein, 9 aa, Artificial Sequence
  Description of Artificial Sequence: Synthetic peptide
QQTRKVPYT

SEQ ID NO: 72 - protein, 11 aa, Artificial Sequence
  Description of Artificial Sequence: Synthetic peptide
GNSITSDYAWN

SEQ ID NO: 73 - protein, 9 aa, Artificial Sequence
  Description of Artificial Sequence: Synthetic peptide
YISYSGSTT

SEQ ID NO: 74 - protein, 112 aa, Artificial Sequence
  Description of Artificial Sequence: Synthetic polypeptide
  MOD_RES (1)..(1): D or E
  MOD_RES (9)..(9): D or A
  MOD_RES (10)..(10): S or T
  MOD_RES (12)..(12): A or S
  MOD_RES (13)..(13): V or L
  MOD_RES (15)..(15): L or P
  MOD_RES (21)..(21): I or L
  MOD_RES (22)..(22): N or S
  MOD_RES (24)..(24): R or K
  MOD_RES (49)..(49): K or R
  MOD_RES (58)..(58): V or R
  MOD_RES (62)..(62): V or I
  MOD_RES (64)..(64): A or D
  MOD_RES (80)..(80): Q or S
  MOD_RES (82)..(82): L or V
  MOD_RES (83)..(83): Q or E
  MOD_RES (85)..(85): P or A
  MOD_RES (88)..(88): F or V
  MOD_RES (89)..(89): A or S
  MOD_RES (92)..(92): Y or F
  MOD_RES (105)..(105): Q or G
  MOD_RES (109)..(109): L or V
XIVLTQSPXXLXXSXGERATXXCXASESVEYFGTSLMHWYQQKPGQPPXLLIYAASNXESGXPXRFSGSGSGTDFTLTIXSXXQXEDXXVYXCQQTRKVPYTFGXGTKXEIK

SEQ ID NO: 75 - protein, 117 aa, Artificial Sequence
  Description of Artificial Sequence: Synthetic polypeptide
  MOD_RES (16)..(16): D or Q
  MOD_RES (23)..(23): A or T
  MOD_RES (41)..(41): P or F
  MOD_RES (45)..(45): G or R
  MOD_RES (49)..(49): I or M
  MOD_RES (70)..(70): I or M
  MOD_RES (88)..(88): A or P
  MOD_RES (89)..(89): V or A
QVQLQESGPGLVKPSXTLSLTCXVSGNSITSDYAWNWIRQXPGKXLEWXGYISYSGSTTYNPSLKSRVTXSRDTSKNQFSLKLSSVTXXDTAVYYCATGYYYGSGFWGQGTLVTVSS

SEQ ID NO: 76 - protein, 8 aa, Artificial Sequence
  Description of Artificial Sequence: Synthetic peptide
GGGSGGGS

SEQ ID NO: 77 - protein, 12 aa, Artificial Sequence
  Description of Artificial Sequence: Synthetic peptide
GGGSGGGSGGGS

SEQ ID NO: 78 - protein, 16 aa, Artificial Sequence
  Description of Artificial Sequence: Synthetic peptide
GGGSGGGSGGGSGGGS

SEQ ID NO: 79 - protein, 20 aa, Artificial Sequence
  Description of Artificial Sequence: Synthetic peptide
GGGSGGGSGGGSGGGSGGGS

SEQ ID NO: 80 - protein, 15 aa, Artificial Sequence
  Description of Artificial Sequence: Synthetic peptide
GGGGSGGGGSGGGGS

SEQ ID NO: 81 - protein, 20 aa, Artificial Sequence
  Description of Artificial Sequence: Synthetic peptide
GGGGSGGGGSGGGGSGGGGS

SEQ ID NO: 82 - protein, 25 aa, Artificial Sequence
  Description of Artificial Sequence: Synthetic peptide
GGGGSGGGGSGGGGSGGGGSGGGGS

SEQ ID NO: 83 - protein, 18 aa, Artificial Sequence
  Description of Artificial Sequence: Synthetic peptide
GSTSGSGKPGSGEGSTKG

SEQ ID NO: 84 - protein, 14 aa, Artificial Sequence
  Description of Artificial Sequence: Synthetic peptide
IRPRAIGGSKPRVA

SEQ ID NO: 85 - protein, 15 aa, Artificial Sequence
  Description of Artificial Sequence: Synthetic peptide
GKGGSGKGGSGKGGS

SEQ ID NO: 86 - protein, 15 aa, Artificial Sequence
  Description of Artificial Sequence: Synthetic peptide
GGKGSGGKGSGGKGS

SEQ ID NO: 87 - protein, 15 aa, Artificial Sequence
  Description of Artificial Sequence: Synthetic peptide
GGGKSGGGKSGGGKS

SEQ ID NO: 88 - protein, 15 aa, Artificial Sequence
  Description of Artificial Sequence: Synthetic peptide
GKGKSGKGKSGKGKS

SEQ ID NO: 89 - protein, 15 aa, Artificial Sequence
  Description of Artificial Sequence: Synthetic peptide
GGGKSGGKGSGKGGS

SEQ ID NO: 90 - protein, 15 aa, Artificial Sequence
  Description of Artificial Sequence: Synthetic peptide
GKPGSGKPGSGKPGS

SEQ ID NO: 91 - protein, 20 aa, Artificial Sequence
  Description of Artificial Sequence: Synthetic peptide
GKPGSGKPGSGKPGSGKPGS

SEQ ID NO: 92 - protein, 20 aa, Artificial Sequence
  Description of Artificial Sequence: Synthetic peptide
GKGKSGKGKSGKGKSGKGKS

SEQ ID NO: 93 - protein, 14 aa, Artificial Sequence
  Description of Artificial Sequence: Synthetic peptide
STAGDTHLGGEDFD

SEQ ID NO: 94 - protein, 15 aa, Artificial Sequence
  Description of Artificial Sequence: Synthetic peptide
GEGGSGEGGSGEGGS

SEQ ID NO: 95 - protein, 15 aa, Artificial Sequence
  Description of Artificial Sequence: Synthetic peptide
GGEGSGGEGSGGEGS

SEQ ID NO: 96 - protein, 15 aa, Artificial Sequence
  Description of Artificial Sequence: Synthetic peptide
GEGESGEGESGEGES

SEQ ID NO: 97 - protein, 15 aa, Artificial Sequence
  Description of Artificial Sequence: Synthetic peptide
GGGESGGEGSGEGGS

SEQ ID NO: 98 - protein, 20 aa, Artificial Sequence
  Description of Artificial Sequence: Synthetic peptide
GEGESGEGESGEGESGEGES

SEQ ID NO: 99 - protein, 18 aa, Artificial Sequence
  Description of Artificial Sequence: Synthetic peptide
GSTSGSGKPGSGEGSTKG

SEQ ID NO: 100 - protein, 19 aa, Artificial Sequence
  Description of Artificial Sequence: Synthetic peptide
PRGASKSGSASQTGSAPGS

SEQ ID NO: 101 - protein, 19 aa, Artificial Sequence
  Description of Artificial Sequence: Synthetic peptide
GTAAAGAGAAGGAAAGAAG

SEQ ID NO: 102 - protein, 19 aa, Artificial Sequence
  Description of Artificial Sequence: Synthetic peptide
GTSGSSGSGSGGSGSGGGG

SEQ ID NO: 103 - protein, 20 aa, Artificial Sequence
  Description of Artificial Sequence: Synthetic peptide
GKPGSGKPGSGKPGSGKPGS

SEQ ID NO: 104 - protein, 4 aa, Artificial Sequence
  Description of Artificial Sequence: Synthetic peptide
GSGS

SEQ ID NO: 105 - protein, 10 aa, Artificial Sequence
  Description of Artificial Sequence: Synthetic peptide
APAPAPAPAP

SEQ ID NO: 106 - protein, 20 aa, Artificial Sequence
  Description of Artificial Sequence: Synthetic peptide
APAPAPAPAPAPAPAPAPAP

SEQ ID NO: 107 - protein, 32 aa, Artificial Sequence
  Description of Artificial Sequence: Synthetic polypeptide
AEAAAKEAAAKEAAAAKEAAAAKEAAAAKAAA

SEQ ID NO: 108 - protein, 16 aa, Artificial Sequence
  Description of Artificial Sequence: Synthetic peptide
GTEGKSSGSGSESKST

SEQ ID NO: 109 - protein, 231 aa, Artificial Sequence
  Description of Artificial Sequence: Synthetic polypeptide
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 110 - protein, 231 aa, Artificial Sequence
  Description of Artificial Sequence: Synthetic polypeptide
EPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 111 - protein, 5 aa, Homo sapiens
KVTEF

SEQ ID NO: 112 - protein, 5 aa, Homo sapiens
HYRKW

SEQ ID NO: 113 - protein, 6 aa, Homo sapiens
SHGWAH

SEQ ID NO: 114 - protein, 15 aa, Homo sapiens
RHNLFEPEDTGQRVP

SEQ ID NO: 115 - protein, 9 aa, Homo sapiens
GWGSIEPEE

SEQ ID NO: 116 - protein, 7 aa, Artificial Sequence
  Description of Artificial Sequence: Synthetic peptide
NNNAAWS

SEQ ID NO: 117 - protein, 18 aa, Artificial Sequence
  Description of Artificial Sequence: Synthetic peptide
RTYYRSKWLYDYAVSVKS

SEQ ID NO: 118 - protein, 8 aa, Artificial Sequence
  Description of Artificial Sequence: Synthetic peptide
GYSSSFDY

SEQ ID NO: 119 - protein, 14 aa, Artificial Sequence
  Description of Artificial Sequence: Synthetic peptide
TGTSSNIGTYKFVS

SEQ ID NO: 120 - protein, 7 aa, Artificial Sequence
  Description of Artificial Sequence: Synthetic peptide
EVSKRPS

SEQ ID NO: 121 - protein, 10 aa, Artificial Sequence
  Description of Artificial Sequence: Synthetic peptide
VSYAGSGTLL

SEQ ID NO: 122 - protein, 120 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSS

SEQ ID NO: 123 - protein, 110 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVL

SEQ ID NO: 124 - protein, 111 aa, Artificial Sequence
  Description of Artificial Sequence: Synthetic polypeptide
DIVLTQSPASLAVSLGQRATISCRASESVEYFGTSLMHWYRQKPGQPPKLLIYAASNVESGVPARFSGSGSGTDFSLNIQPVEEDDFSMYFCQQTRKVPYTFGGGTKLEIK

SEQ ID NO: 125 - protein, 117 aa, Artificial Sequence
  Description of Artificial Sequence: Synthetic polypeptide
DVQLQESGPGLVKPSQSLSLTCTVTGNSITSDYAWNWIRQFPGNRLEWMGYISYSGSTTYSPSLKSRFSITRDTSKNQFFLQLNSVTPEDTATYFCATGYYYGSGFWGQGTLVTVSS

SEQ ID NO: 126 - protein, 15 aa, Artificial Sequence
  Description of Artificial Sequence: Synthetic peptide
EPKSCDKTHTCPPCP

SEQ ID NO: 127 - protein, 12 aa, Artificial Sequence
  Description of Artificial Sequence: Synthetic peptide
ERKCCVECPPCP

SEQ ID NO: 128 - protein, 62 aa, Artificial Sequence
  Description of Artificial Sequence: Synthetic polypeptide
ELKTPLGDTTHTCPRCPEPKSCDTPPPCPRCPEPKSCDTPPPCPRCPEPKSCDTPPPCPRCP

SEQ ID NO: 129 - protein, 12 aa, Artificial Sequence
  Description of Artificial Sequence: Synthetic peptide
ESKYGPPCPSCP

SEQ ID NO: 130 - protein, 330 aa, Unknown [sequence omitted]

SEQ ID NO: 131 - protein, 326 aa, Unknown
  Description of Unknown: wild-type IgG2 sequence
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 132 - protein, 327 aa, Unknown
  Description of Unknown: wild-type IgG4 sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 133 - protein, 251 aa, Artificial Sequence
  Description of Artificial Sequence: Synthetic polypeptide
EVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSGGSEGKSSGSGSESKSTGGSEIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIK

SEQ ID NO: 134 - protein, 251 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKGGSEGKSSGSGSESKSTGGSEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSS

SEQ ID NO: 135 - protein, 248 aa, Artificial Sequence
  Description of Artificial Sequence: Synthetic polypeptide
QVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 136 - protein, 248 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSS

SEQ ID NO: 137 - protein, 124 aa, Artificial Sequence
  Description of Artificial Sequence: Synthetic polypeptide
EVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSS

SEQ ID NO: 138 - protein, 107 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIK

SEQ ID NO: 139 - protein, 117 aa, Artificial Sequence
  Description of Artificial Sequence: Synthetic polypeptide
QVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSS

SEQ ID NO: 140 - protein, 111 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 141 - protein, 5 aa, Artificial Sequence
  Description of Artificial Sequence: Synthetic peptide
SYWMT

SEQ ID NO: 142 - protein, 17 aa, Artificial Sequence
  Description of Artificial Sequence: Synthetic peptide
NIKQDGSERYYVDSVKG

SEQ ID NO: 143 - protein, 15 aa, Artificial Sequence
  Description of Artificial Sequence: Synthetic peptide
DQNYDILTGHYGMDV

SEQ ID NO: 144 - protein, 11 aa, Artificial Sequence
  Description of Artificial Sequence: Synthetic peptide
RASQGISSYLS

SEQ ID NO: 145 - protein, 7 aa, Artificial Sequence
  Description of Artificial Sequence: Synthetic peptide
ATSTLQS

SEQ ID NO: 146 - protein, 9 aa, Artificial Sequence
  Description of Artificial Sequence: Synthetic peptide
QQLNSYPRT

SEQ ID NO: 147 - protein, 10 aa, Artificial Sequence
  Description of Artificial Sequence: Synthetic peptide
GFTFSSYWMT

SEQ ID NO: 148 - protein, 10 aa, Artificial Sequence
  Description of Artificial Sequence: Synthetic peptide
NIKQDGSERY

SEQ ID NO: 149 - protein, 270 aa, Artificial Sequence
  Description of Artificial Sequence: Synthetic polypeptide
MAWVWTLLFLMAAAQSIQAEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSGGSEGKSSGSGSESKSTGGSEIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIK

SEQ ID NO: 150 - protein, 270 aa, Artificial Sequence
  Description of Artificial Sequence: Synthetic polypeptide
MAWVWTLLFLMAAAQSIQAEIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKGGSEGKSSGSGSESKSTGGSEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSS

SEQ ID NO: 151 - protein, 267 aa, Artificial Sequence
  Description of Artificial Sequence: Synthetic polypeptide
MAWVWTLLFLMAAAQSIQAQVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 152 - protein, 267 aa, Artificial Sequence
  Description of Artificial Sequence: Synthetic polypeptide
MAWVWTLLFLMAAAQSIQAEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSS

SEQ ID NO: 153 - protein, 474 aa, Artificial Sequence
  Description of Artificial Sequence: Synthetic polypeptide
EVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSGGSEGKSSGSGSESKSTGGSEIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 154 - protein, 474 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKGGSEGKSSGSGSESKSTGGSEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 155 - protein, 471 aa, Artificial Sequence
  Description of Artificial Sequence: Synthetic polypeptide
QVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 156 - protein, 471 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 157 - protein, 107 aa, Artificial Sequence
  Description of Artificial Sequence: Synthetic polypeptide
  MOD_RES (4)..(4): L or M
  MOD_RES (9)..(9): G or S
  MOD_RES (10)..(10): I or S
  MOD_RES (13)..(13): V or A
  MOD_RES (15)..(15): P or V
  MOD_RES (17)..(17): E or D
  MOD_RES (20)..(20): S or T
  MOD_RES (21)..(21): F or I
  MOD_RES (22)..(22): S or T
  MOD_RES (40)..(40): T or P
  MOD_RES (41)..(41): N or G
  MOD_RES (42)..(42): G or K
  MOD_RES (43)..(43): S or A
  MOD_RES (45)..(45): R or K
  MOD_RES (49)..(49): K or Y
  MOD_RES (58)..(58): I or V
  MOD_RES (76)..(76): N or S
  MOD_RES (78)..(78): V or L
  MOD_RES (80)..(80): S or P
  MOD_RES (83)..(83): I or F
  MOD_RES (85)..(85): D or T
  MOD_RES (92)..(92): N or G
  MOD_RES (100)..(100): G or Q
DIQXTQSPXXLSXSXGXRVXXXCRARQSIGTAIHWYQQKXXXXPXLLIXYASESISGXPSRFSGSGSGTDFTLTIXSXQXEDXAXYYCQQSXSWPYTFGXGTKLEIK

SEQ ID NO: 158 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 159 - protein, 117 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 160 - protein, 111 aa, Artificial Sequence
  Description of Artificial Sequence: Synthetic polypeptide
DIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIK

SEQ ID NO: 161 - protein, 117 aa, Artificial Sequence
  Description of Artificial Sequence: Synthetic polypeptide
QVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSS

SEQ ID NO: 162 - protein, 125 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 163 - protein, 107 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 164 - protein, 123 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSS

SEQ ID NO: 165 - protein, 107 aa, Artificial Sequence
  Description of Artificial Sequence: Synthetic polypeptide
DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIK

SEQ ID NO: 166 - protein, 119 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSS

SEQ ID NO: 167 - protein, 106 aa, Artificial Sequence
  Description of Artificial Sequence: Synthetic polypeptide
SYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVL

SEQ ID NO: 168 - protein, 121 aa, Artificial Sequence
  Description of Artificial Sequence: Synthetic polypeptide
QVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSS

SEQ ID NO: 169 - protein, 108 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTV

SEQ ID NO: 170 - protein, 5 aa, Artificial Sequence
  Description of Artificial Sequence: Synthetic peptide
SYYWS

SEQ ID NO: 171 - protein, 16 aa, Artificial Sequence
  Description of Artificial Sequence: Synthetic peptide
YIYYSGSTNYNPSLKS

SEQ ID NO: 172 - protein, 17 aa, Artificial Sequence
  Description of Artificial Sequence: Synthetic peptide
TTIFGVVTPNFYYGMDV

SEQ ID NO: 173 - protein, 11 aa, Artificial Sequence
  Description of Artificial Sequence: Synthetic peptide
RASQGISSYLA

SEQ ID NO: 174 - protein, 7 aa, Artificial Sequence
  Description of Artificial Sequence: Synthetic peptide
AASTLQS

SEQ ID NO: 175 - protein, 9 aa, Artificial Sequence
  Description of Artificial Sequence: Synthetic peptide
QQLNSYPLT

SEQ ID NO: 176 - protein, 5 aa, Artificial Sequence
  Description of Artificial Sequence: Synthetic peptide
SYDIH

SEQ ID NO: 177 - protein, 17 aa, Artificial Sequence
  Description of Artificial Sequence: Synthetic peptide
IISYDGSKKDYTDSVKG

SEQ ID NO: 178 - protein, 14 aa, Artificial Sequence
  Description of Artificial Sequence: Synthetic peptide
ESGWSHYYYYGMDV

SEQ ID NO: 179 - protein, 11 aa, Artificial Sequence
  Description of Artificial Sequence: Synthetic peptide
RASQDISNYLA

SEQ ID NO: 180 - protein, 7 aa, Artificial Sequence
  Description of Artificial Sequence: Synthetic peptide
AASTLHS

SEQ ID NO: 181 - protein, 9 aa, Artificial Sequence
  Description of Artificial Sequence: Synthetic peptide
QKYNSAPYT

SEQ ID NO: 182 - protein, 11 aa, Artificial Sequence
  Description of Artificial Sequence: Synthetic peptide
GGNNIGSKSVH

SEQ ID NO: 183 - protein, 16 aa, Artificial Sequence
  Description of Artificial Sequence: Synthetic peptide
RLYVSGFTNYNPSLKS

SEQ ID NO: 184 - protein, 11 aa, Artificial Sequence
  Description of Artificial Sequence: Synthetic peptide
DSGNYWGWFDP

SEQ ID NO: 185 - protein, 11 aa, Artificial Sequence
  Description of Artificial Sequence: Synthetic peptide
SGDQLGENYAC

SEQ ID NO: 186 - protein, 7 aa, Artificial Sequence
  Description of Artificial Sequence: Synthetic peptide
QDSKRPS

SEQ ID NO: 187 - protein, 9 aa, Artificial Sequence
  Description of Artificial Sequence: Synthetic peptide
QAWDNSIVV

SEQ ID NO: 188 - protein, 5 aa, Artificial Sequence
  Description of Artificial Sequence: Synthetic peptide
YYGMH

SEQ ID NO: 189 - protein, 17 aa, Artificial Sequence
  Description of Artificial Sequence: Synthetic peptide
FISYDGSNKYYADSVKG

SEQ ID NO: 190 - protein, 12 aa, Artificial Sequence
  Description of Artificial Sequence: Synthetic peptide
LPYSGSYWAFDY

SEQ ID NO: 191 - protein, 11 aa, Artificial Sequence
  Description of Artificial Sequence: Synthetic peptide
GGDNIGSKSVH

SEQ ID NO: 192 - protein, 7 aa, Artificial Sequence
  Description of Artificial Sequence: Synthetic peptide
DNSDRPS

SEQ ID NO: 193 - protein, 12 aa, Artificial Sequence
  Description of Artificial Sequence: Synthetic peptide
QVWDSSSDHPVV

SEQ ID NO: 194 - protein, 10 aa, Artificial Sequence
  Description of Artificial Sequence: Synthetic peptide
GGSISSYYWS

SEQ ID NO: 195 - protein, 9 aa, Artificial Sequence
  Description of Artificial Sequence: Synthetic peptide
YIYYSGSTN

SEQ ID NO: 196 - protein, 10 aa, Artificial Sequence
  Description of Artificial Sequence: Synthetic peptide
GFTFSSYDIH

SEQ ID NO: 197 - protein, 10 aa, Artificial Sequence
  Description of Artificial Sequence: Synthetic peptide
IISYDGSKKD

SEQ ID NO: 198 - protein, 10 aa, Artificial Sequence
  Description of Artificial Sequence: Synthetic peptide
GGSISSYYWS

SEQ ID NO: 199 - protein, 9 aa, Artificial Sequence
  Description of Artificial Sequence: Synthetic peptide
RLYVSGFTN

SEQ ID NO: 200 - protein, 7 aa, Artificial Sequence
  Description of Artificial Sequence: Synthetic peptide
GFTFSYY

SEQ ID NO: 201 - protein, 10 aa, Artificial Sequence
  Description of Artificial Sequence: Synthetic peptide
FISYDGSNKY

SEQ ID NO: 202 - protein, 447 aa, Artificial Sequence
  Description of Artificial Sequence: Synthetic polypeptide
DVQLQESGPGLVKPSQSLSLTCTVTGNSITSDYAWNWIRQFPGNRLEWMGYISYSGSTTYSPSLKSRFSITRDTSKNQFFLQLNSVTPEDTATYFCATGYYYGSGFWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 203 - protein, 447 aa, Artificial Sequence
  Description of Artificial Sequence: Synthetic polypeptide
QVQLQESGPGLVKPSDTLSLTCAVSGNSITSDYAWNWIRQPPGKGLEWIGYISYSGSTTYNPSLKSRVTMSRDTSKNQFSLKLSSVTAVDTAVYYCATGYYYGSGFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 125 aa, Artificial Sequence
  Description of Artificial Sequence: Synthetic polypeptide
QVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSS

SEQ ID NO: 205 - protein, 108 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 206 - protein, 5 aa, Artificial Sequence
  Description of Artificial Sequence: Synthetic peptide
HYAMS

SEQ ID NO: 207 - protein, 17 aa, Artificial Sequence
  Description of Artificial Sequence: Synthetic peptide
TIGGSGGSTYYADSVKG

SEQ ID NO: 208 - protein, 16 aa, Artificial Sequence
  Description of Artificial Sequence: Synthetic peptide
PHIVMVTALLYDGMDV

SEQ ID NO: 209 - protein, 11 aa, Artificial Sequence
  Description of Artificial Sequence: Synthetic peptide
QVWDSSSDHVV

SEQ ID NO: 210 - protein, 452 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 211 - protein, 450 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 212 - protein, 446 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - protein, 451 aa, Artificial Sequence
  Description of Artificial Sequence: Synthetic polypeptide
QVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 218 aa, Artificial Sequence
  Description of Artificial Sequence: Synthetic polypeptide
DIVLTQSPASLAVSLGQRATISCRASESVEYFGTSLMHWYRQKPGQPPKLLIYAASNVESGVPARFSGSGSGTDFSLNIQPVEEDDFSMYFCQQTRKVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 215 - protein, 218 aa, Artificial Sequence
  Description of Artificial Sequence: Synthetic polypeptide
DIVLTQSPDSLAVSLGERATINCKASESVEYFGTSLMHWYQQKPGQPPKLLIYAASNRESGVPDRFSGSGSGTDFTLTISSLQAEDVAVYYCQQTRKVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - protein, 10 aa, Artificial Sequence
  Description of Artificial Sequence: Synthetic peptide
GFTFSHYAMS

SEQ ID NO: 217 - protein, 11 aa, Artificial Sequence
  Description of Artificial Sequence: Synthetic peptide
TIGGSGGSTYY

SEQ ID NO: 218 - protein, 16 aa, Artificial Sequence
  Description of Artificial Sequence: Synthetic peptide
PHIVMVTALLYDGMDV

SEQ ID NO: 219 - protein, 455 aa, Artificial Sequence
  Description of Artificial Sequence: Synthetic polypeptide
QVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 214 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 221 - protein, 214 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 214 aa, Artificial Sequence
  Description of Artificial Sequence: Synthetic polypeptide
DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 223 - protein, 212 aa, Artificial Sequence
  Description of Artificial Sequence: Synthetic polypeptide
SYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 224 - protein, 215 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 225 - DNA, 351 bp, Artificial Sequence
  Description of Artificial Sequence: Synthetic polynucleotide
gatgtgcagcttcaggagtctggacccggacttgttaaaccaagtcagtctctgtccctgacctgtaccgtcaccggcaacagcatcacaagcgattacgcatggaactggatcaggcagttccctggaaatcgactcgaatggatgggctacatttcatactccggttcaaccacttactctccatccttgaaatctaggttcagcatcacccgtgatacctcaaagaaccaattttttctgcaactgaatagcgtaactccagaggacacagccacatatttctgcgccactgggtattactatggctcaggtttctggggtcagggcactctcgtcaccgtcagcagc

SEQ ID NO: 226 - DNA, 351 bp, Artificial Sequence
  Description of Artificial Sequence: Synthetic polynucleotide
caggtccaactgcaagagagcggaccgggcctggtaaagccatccgacacattgtccctgacgtgtgcggtaagtggaaactctatcactagcgactatgcgtggaattggataagacaaccgccgggcaaggggctggaatggataggatatatcagctattccggttctacgacatacaatccttccctgaaaagcagagtcactatgtcacgcgacacgtccaagaatcagttctcattgaaattgtcatccgtaacggccgttgacactgcggtttattattgcgcaaccggatattactacggctctggtttttggggacagggaacacttgttactgttagttca

SEQ ID NO: 227 - DNA, 351 bp, Artificial Sequence
  Description of Artificial Sequence: Synthetic polynucleotide
caggtgcagctgcaggagagcggcccaggcctggtgaagccaagcgacaccctgagcctgacctgcgccgtgagcggcaacagcatcaccagcgactacgcctggaactggatccgccagttcccaggcaagggcctggagtggatcggctacatcagctacagcggcagcaccacctacaacccaagcctgaagagccgcgtcaccatcagccgcgacaccagcaagaaccagttcagcctgaagctgagcagcgtgacccctgtggacaccgccgtgtactactgcgccaccggctactactacggcagcggcttctggggccagggcaccctggtgaccgtgagcagc

SEQ ID NO: 228 - DNA, 351 bp, Artificial Sequence
  Description of Artificial Sequence: Synthetic polynucleotide
caggtgcagctgcaggagagcggcccaggcctggtgaagccaagcgacaccctgagcctgacctgcgccgtgagcggcaacagcatcaccagcgactacgcctggaactggatccgccagttcccaggcaagggcctggagtggatgggctacatcagctacagcggcagcaccacctacaacccaagcctgaagagccgcgtcaccatcagccgcgacaccagcaagaaccagttcagcctgaagctgagcagcgtgacccctgtggacaccgccgtgtactactgcgccaccggctactactacggcagcggcttctggggccagggcaccctggtgaccgtgagcagc

SEQ ID NO: 229 - DNA, 351 bp, Artificial Sequence
  Description of Artificial Sequence: Synthetic polynucleotide
caggttcagctgcaagagtctggaccaggcctggtcaagccctctcagaccctgtctctgacctgtaccgtgtccggcaactccatcacctctgactacgcctggaactggattcggcagttccctggcaagggccttgagtggatcggctacatctcctactccggttccaccacctacaaccccagcctgaagtcccgggtcaccatctcccgcgacacctccaagaaccagttctccctgaagctgtcctccgtgaccgctgctgataccgccgtgtactactgtgccaccggctactactacggctccggcttttggggacagggcacactggttaccgtgtctagt

SEQ ID NO: 230 - DNA, 351 bp, Artificial Sequence
  Description of Artificial Sequence: Synthetic polynucleotide
caggttcagctgcaagagtctggaccaggcctggtcaagccctctcagaccctgtctctgacctgtaccgtgtccggcaactccatcacctctgactacgcctggaactggattcggcagccacctggcaagggccttgagtggatcggctacatctcctactccggttccaccacctacaaccccagcctgaagtcccgggtcaccatctcccgcgacacctccaagaaccagttctccctgaagctgtcctccgtgaccgctgctgataccgccgtgtactactgtgccaccggctactactacggctccggcttttggggacagggcacactggttaccgtgtctagt

SEQ ID NO: 231 - DNA, 351 bp, Artificial Sequence
  Description of Artificial Sequence: Synthetic polynucleotide
caggttcagctgcaagagtctggaccaggcctggtcaagccctctcagaccctgtctctgacctgtaccgtgtccggcaactccatcacctctgactacgcctggaactggattcggcagttccctggcaagcgccttgagtggatcggctacatctcctactccggttccaccacctacaaccccagcctgaagtcccgggtcaccatctcccgcgacacctccaagaaccagttctccctgaagctgtcctccgtgaccgctgctgataccgccgtgtactactgtgccaccggctactactacggctccggcttttggggacagggcacactggttaccgtgtctagt

SEQ ID NO: 232 - DNA, 372 bp, Artificial Sequence
  Description of Artificial Sequence: Synthetic polynucleotide
gaggtgcaacttgtggagagcggcggaggtctggtccaacccggaggaagtctccgtctctcctgtgctgctagtggcttcactttcagctcatattggatgacatgggtgagacaagccccaggaaaggggctcgagtgggtagctaacattaaacaggacggctccgaacggtactatgttgattctgtgaagggacggttcactatatccagggataatgcaaaaaattcactctatcttcaaatgaactcactcagagcagaggacactgccgtgtattattgcgccagggatcaaaattatgacatactgaccggtcattatggaatggatgtttggggccagggaacaaccgttaccgtctcaagt

SEQ ID NO: 233 - DNA, 375 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgcggacacggccgtgtattactgtgcggggactacgatttttggagtggttacccccaacttctactacggtatggacgtctggggccaagggaccacggtcaccgtctcctca

SEQ ID NO: 234 - DNA, 369 bp, Artificial Sequence
  Description of Artificial Sequence: Synthetic polynucleotide
gaggtgcagctggtggagtctgggggaggcgtggtccagcctgggaggtccctgagactctcctgtgtagcctctggattcaccttcagtagttatgacatacactgggtccgccaggctccaggcaaggggctggagtgggtggcaattatttcatatgatggaagtaaaaaagactatacagactccgtgaagggccgattcaccatctccagagacaattccaagaacacgctgtatctgcaaatggacagcctgagagttgaggactcggctgtgtattcctgtgcgagagaaagtggctggtcccactactactattacggtatggacgtctggggccaagggacaatggtcaccgtctcttca

SEQ ID NO: 235 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactattggagctggctccggcagcccgccgggtcgggactggagtggattgggcgtttatatgtcagtgggttcaccaactacaacccctccctcaagagtcgagtcaccttgtcactagacccgtccaggaaccagttgtccctgaaactgagttctgtgaccgccgcggacacggccgtatattattgtgcgggagatagtgggaactactggggttggttcgacccctggggccagggaaccctggtcaccgtctcctca

SEQ ID NO: 236 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcatttatatcatatgatggaagtaataaatactatgcagactccgtgaagggccgattcaccatctccagagacaattccaagaacacgctgtatctgcaaatgaacagcctgagagctgaggacacggctgtgtattactgtgcccacctcccttatagtgggagctactgggcctttgactactggggccagggaacccaggtcaccgtctcttca

SEQ ID NO: 237 - DNA, 333 bp, Artificial Sequence
  Description of Artificial Sequence: Synthetic polynucleotide
gacattgtgctgacacagagtccagcatccttggcagtatctttggggcagcgggcaacaatttcatgccgtgcatctgaaagtgtggagtattttggaacttctcttatgcactggtatcgccagaagcctgggcagcctcccaaactccttatatatgccgcttccaacgtggagtccggagtaccagcacgcttttccggctctgggtccggcacagacttttccctcaatatccaacctgttgaagaagacgatttttccatgtatttttgccaacagacacgcaaggttccatatacattcggcggcggcactaaacttgagatcaaa

SEQ ID NO: 238 - DNA, 333 bp, Artificial Sequence
  Description of Artificial Sequence: Synthetic polynucleotide
gacatagtcttgactcagagcccggattcccttgctgtgtctctgggagaacgagctacgatcaactgcaaggcaagtgaatccgtagaatacttcgggacatcattgatgcattggtatcaacagaaaccggggcaaccgcccaaattgctgatatatgcggctagtaatagagaatcaggagtaccggataggtttagtggttcaggatcaggtacagatttcaccctgacaataagtagcttgcaagccgaagacgtagcagtgtattactgccaacaaacccgaaaggtgccatatacgtttggacagggtacaaagttggaaatcaaa

SEQ ID NO: 239 - DNA, 333 bp, Artificial Sequence
  Description of Artificial Sequence: Synthetic polynucleotide
gacatcgtgctgacccagagcccagacagcctggccgtgagcctgggcgagcgcgccaccatcaactgcaaggccagcgagagcgtggagtacttcggcaccagcctgatgcactggtaccagcagaagccaggccagccaccaaagctgctgatctacgctgccagcaaccgcgagagcggcgtgccagaccgcttcagcggcagcggcagcggcaccgacttcaccctgaccatccagagcgtgcaggccgaggacgtctccgtgtacttctgccagcagacccgcaaggtgccatacaccttcggccagggcaccaagctggagatcaag

SEQ ID NO: 240 - DNA, 333 bp, Artificial Sequence
  Description of Artificial Sequence: Synthetic polynucleotide
gacatcgtgctgacccagagcccagacagcctggccgtgagcctgggcgagcgcgccaccatcaactgcaaggccagcgagagcgtggagtacttcggcaccagcctgatgcactggtaccagcagaagccaggccagccaccaaagctgctgatctacgctgccagcaaccgcgagagcggcgtgccagaccgcttcagcggcagcggcagcggcaccgacttcaccctgaccatcagcagcgtgcaggccgaggacgtcgccgtgtactactgccagcagacccgcaaggtgccatacaccttcggccagggcaccaagctggagatcaag

SEQ ID NO: 241 - DNA, 333 bp, Artificial Sequence
  Description of Artificial Sequence: Synthetic polynucleotide
gacatcgtgctgacccagtctccagactctctggctgtgtctctgggcgagagagccaccatcaactgcagagcctccgagtccgtggaatacttcggcacctctctgatgcactggtaccagcagaagcccggccagcctcctaagctgctgatctacgccgcctccaacgtggaatctggcgtgcccgatagattttccggctctggctctggcaccgactttaccctgaccatcagctctctgcaggccgaggatgtggccgtgtacttctgtcagcagacccggaaggtgccctacacatttggcggcggaacaaaggtggaaatcaag

SEQ ID NO: 242 - DNA, 333 bp, Artificial Sequence
  Description of Artificial Sequence: Synthetic polynucleotide
gagatcgtgctgacccagtctcctgccacactgtcactgtctccaggcgagagagccaccctctcttgtagagcctccgagtccgtggaatacttcggcacctctctgatgcactggtaccagcagaagcccggccagcctcctagactgctgatctacgccgcctccaacgtcgaatctggcatccccgctagattctccggctctggctctggcacagactttaccctgaccatctcctccgtggaacccgaggatttcgctgtgtacttttgccagcagacccggaaggtgccctacacatttggcggcggaacaaaggtggaaatcaag

SEQ ID NO: 243 - DNA, 321 bp, Artificial Sequence
  Description of Artificial Sequence: Synthetic polynucleotide
gaaatcgtactgacccagtccccttctttcttgagtgcatcagttggggatagagtgaccattacttgtagagcatctcaaggtatttcttcatacttgtcttggtatcaacaaaaacctggcaaggcacccaaactcttgatctacgccacctctacattgcaaagtggggttccttctaggttttcaggctccggctctggtaccgagttcaccctcactataagcagtctccaacctgaagatttcgctacttattattgtcagcagcttaattcttatccccgaacctttggtcaaggaactaaggtcgagatcaaa

SEQ ID NO: 244 - DNA, 321 bp, Artificial Sequence
  Description of Artificial Sequence: Synthetic polynucleotide
gacatccagatgacccagtctccttccttcctgtctgcatctgtaggagacagagtcaccatcacttgccgggccagtcagggcattagcagttatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggaaatcaaa

SEQ ID NO: 245 - DNA, 321 bp, Artificial Sequence
  Description of Artificial Sequence: Synthetic polynucleotide
gacatcgtgatgacccagtctccatcctccctgtctgcatctgtaggagacagagtcaccatcacttgccgggcgagtcaggacattagcaattatttagcctggtatcagcagaaaccagggaaagttcctaagttcctgatctatgctgcatccactttgcactctggggtcccatctcggttcagtggcagtggatctgggacagatttcactctcaccatcagcagcctgcagcctgaagatgttgcaacttattactgtcaaaagtataacagtgccccgtacacttttggccaagggacacgactggagattaaa

SEQ ID NO: 246 - DNA, 318 bp, Artificial Sequence
  Description of Artificial Sequence: Synthetic polynucleotide
tcctatgagctgactcagccaccctcagtgtccgtgtccccaggagagacagccagcatcacctgctctggagatcaattgggggaaaattatgcttgctggtatcagcagaagccaggccagtcccctgtgttggtcatctatcaagatagtaagcggccctcagggatccctgagcgattctctggctccaactctgggaacacagccactctgaccatcagcgggacccaggctctggatgaggctgactattactgtcaggcgtgggacaacagtattgtggtattcggcggagggaccaagctgaccgtccta

SEQ ID NO: 247 - DNA, 327 bp, Artificial Sequence
  Description of Artificial Sequence: Synthetic polynucleotide
cagtctgtgctgactcagccaccctcggtgtcagtggcccccgggcagacggccagtattacctgtgggggagacaacattggaagtaaaagtgtgcactggtaccagcagaagccaggccaggcccctgtgctggtcgtctatgataatagcgaccggccctcagggatccctgagcgattctctggctccaactctgggaccacggccaccctgaccatcagcagggtcgaagccggggatgaggccgactattactgtcaggtgtgggatagtagtagtgatcatcctgtggtattcggcggagggaccaaggtcaccgtccta

SEQ ID NO: 248 - protein, 116 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 249 - protein, 107 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIK

SEQ ID NO: 250 - protein, 107 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK

SEQ ID NO: 251 - protein, 107 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIK

SEQ ID NO: 252 - protein, 107 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK

SEQ ID NO: 253 - protein, 107 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK

SEQ ID NO: 254 - protein, 107 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK

SEQ ID NO: 255 - protein, 5 aa, Artificial Sequence
  Description of Artificial Sequence: Synthetic peptide
RYNMN

SEQ ID NO: 256 - protein, 17 aa, Artificial Sequence
  Description of Artificial Sequence: Synthetic peptide
SISTSSNYIYYADSVKG

SEQ ID NO: 257 - protein, 7 aa, Artificial Sequence
  Description of Artificial Sequence: Synthetic peptide
GWGPFDY

SEQ ID NO: 258 - protein, 11 aa, Artificial Sequence
  Description of Artificial Sequence: Synthetic peptide
RARQSIGTAIH

SEQ ID NO: 259 - protein, 7 aa, Artificial Sequence
  Description of Artificial Sequence: Synthetic peptide
YASESIS

SEQ ID NO: 260 - protein, 9 aa, Artificial Sequence
  Description of Artificial Sequence: Synthetic peptide
QQSNSWPYT

SEQ ID NO: 261 - protein, 9 aa, Artificial Sequence
  Description of Artificial Sequence: Synthetic peptide
QQSGSWPYT

SEQ ID NO: 262 - protein, 446 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - DNA, 375 bp, Artificial Sequence
  Description of Artificial Sequence: Synthetic polynucleotide
caggtgcagctggtggagtctgggggaggcttggtacagcctggggggtccctgagactctcctgtgcagcctctggattcacctttagtcattatgccatgagctgggtccgccaggctccagggaaggggctggagtgggtctcaactattggtggtagtggtggtagcacatactacgcagactccgtgaagggccggttcaccatctccagagacaattccaagaacacgctgtatctgcaaatgaacagcctgagagccgaggacacggccgtatattactgtgcgaaacctcatattgtaatggtgactgctcttctctacgacggtatggacgtctggggccaagggacaatggtcaccgtctcctca

SEQ ID NO: 264 - protein, 446 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 265 - protein, 214 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 266 - protein, 214 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 267 - protein, 214 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 268 - protein, 214 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 269 - protein, 214 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 270 - protein, 214 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - DNA, 324 bp, Artificial Sequence
  Description of Artificial Sequence: Synthetic polynucleotide
tcttctgagctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtccta

SEQ ID NO: 272 - protein, 216 aa, Artificial Sequence
  Description of Artificial Sequence: Synthetic polypeptide
QSALTQPASVSGSPGQSITISCTGTSSNIGTYKFVSWYQQHPDKAPKVLLYEVSKRPSGVSSRFSGSKSGNTASLTISGLQAEDQADYHCVSYAGSGTLLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 273 - DNA, 348 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctca

SEQ ID NO: 274 - DNA, 1365 bp, Artificial Sequence
  Description of Artificial Sequence: Synthetic polynucleotide
caggtgcagctggtggagtctgggggaggcttggtacagcctggggggtccctgagactctcctgtgcagcctctggattcacctttagtcattatgccatgagctgggtccgccaggctccagggaaggggctggagtgggtctcaactattggtggtagtggtggtagcacatactacgcagactccgtgaagggccggttcaccatctccagagacaattccaagaacacgctgtatctgcaaatgaacagcctgagagccgaggacacggccgtatattactgtgcgaaacctcatattgtaatggtgactgctcttctctacgacggtatggacgtctggggccaagggacaatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagagcctctccctgtctccgggtaaa

SEQ ID NO: 275 - DNA, 360 bp, Artificial Sequence
  Description of Artificial Sequence: Synthetic polynucleotide
caggtgcagctgcagcagtctggccctagactcgtgcggccttcccagaccctgtctctgacctgtgccatctccggcgactccgtgttcaacaacaacgccgcctggtcctggatccggcagagcccttctagaggcctggaatggctgggccggacctactaccggtccaagtggctgtacgactacgccgtgtccgtgaagtcccggatcaccgtgaaccctgacacctcccggaaccagttcaccctgcagctgaactccgtgacccctgaggacaccgccctgtactactgcgccagaggctactcctcctccttcgactattggggccagggcaccctcgtgaccgtgtcctct

SEQ ID NO: 276 - DNA, 321 bp, Artificial Sequence
  Description of Artificial Sequence: Synthetic polynucleotide
gatatacttcttacccagagtcccggcatcctctccgttagccctggggagagagtctcattctcatgccgagccagacagtcaattggtaccgcaatacactggtatcaacagcggaccaatggttctccccgacttctgataaagtacgcatcagaatcaattagtggaataccatcaagatttagtggctcagggagtggaaccgattttactctgaccatcaactcagtggaatctgaggacattgccgactactactgtcaacaaagcaatagttggccatataccttcggaggcggaactaaattggagataaaa

SEQ ID NO: 277 - DNA, 321 bp, Artificial Sequence
  Description of Artificial Sequence: Synthetic polynucleotide
gacatccagatgacacagtcaccttctagtttgtctgcttctgtaggcgaccgtgtaactatcacctgtcgagcccgtcaaagtattggtactgccattcactggtaccaacaaaaacctggcaaagctccaaaactcttgatctactatgcctccgaaagcatatcaggggtcccaagcagattctcaggcagtggcagtggcactgacttcactctcaccatttctagcgtgcaaccagaggacttcgccacttattactgccaacagtcagggagctggccctacaccttcggccaaggtacaaaactggagatcaaa

SEQ ID NO: 278 - DNA, 321 bp, Artificial Sequence
  Description of Artificial Sequence: Synthetic polynucleotide
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaag

SEQ ID NO: 279 - DNA, 321 bp, Artificial Sequence
  Description of Artificial Sequence: Synthetic polynucleotide
gacatccaaatgactcaatcacctagcagcctctccgcctccgttggagatagagtgacaataacttgccgagcccggcaaagtatcggaactgctattcactggtatcaacaaaaacctggaaaggcacctaagctcttgattaaatacgcttctgagtccatctccggcgtgccttcacgattcagcggcagcggtagtggtactgactttaccctcactattagttctgttcagccagaggacttcgcaacttattactgccaacagagtggttcctggccatacacttttggccaggggactaaattggaaatcaaa

SEQ ID NO: 280 - DNA, 321 bp, Artificial Sequence
  Description of Artificial Sequence: Synthetic polynucleotide
gacatccaaatgactcaaagcccctctagtttgagtgcatctgtaggtgaccgggtaacaatcacctgccgtgcccggcaaagtataggtactgcaatccactggtaccagcaaaaacccggcaaagcaccaaagctgctcatatactatgctagtgagagcatttctggcgttcctagtcgattttctggatcagggagtggaactgattttacactgacaatcagcagcctccaacccgaagacttcgccacctactattgtcagcagtctgggtcctggccttacacattcggtcaaggaactaaattggagatcaaa

SEQ ID NO: 281 - DNA, 321 bp, Artificial Sequence
  Description of Artificial Sequence: Synthetic polynucleotide
gacattttgctgacacagagccctggtatcctctcagtcagtccaggggaacgcgtttcatttagctgccgtgctcgacagagcattgggaccgcaatccactggtaccaacaaagaactaacggttcaccacggcttttgattaagtatgcctccgaatccatcagtggcattcctagtcgtttttctggatcaggatcaggcaccgactttactctcacaattaatagtgtcgaaagtgaggacattgcagactattattgtcagcaatccggttcctggccctatacttttggtggtggtactaagttggaaattaaa

SEQ ID NO: 282 - DNA, 642 bp, Artificial Sequence
  Description of Artificial Sequence: Synthetic polynucleotide
tcttctgagctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 283 - DNA, 329 bp, Artificial Sequence
  Description of Artificial Sequence: Synthetic polynucleotide
agtctgctctgacccagcctgcctccgtgtctggctctcccggccagtccatcaccatcagctgtaccggcacctcctccaacatcggcacctacaagttcgtgtcctggtatcagcagcaccccgacaaggcccccaaagtgctgctgtacgaggtgtccaagcggccctctggcgtgtcctccagattctccggctccaagtctggcaacaccgcctccctgaccatcagcggactgcaggctgaggaccaggccgactaccactgtgtgtcctacgctggctctggcaccctgctgtttggcggaggcaccaagctgaccgtgctg

SEQ ID NO: 284 - DNA, 1341 bp, Artificial Sequence
  Description of Artificial Sequence: Synthetic polynucleotide
gatgtgcagcttcaggagtctggacccggacttgttaaaccaagtcagtctctgtccctgacctgtaccgtcaccggcaacagcatcacaagcgattacgcatggaactggatcaggcagttccctggaaatcgactcgaatggatgggctacatttcatactccggttcaaccacttactctccatccttgaaatctaggttcagcatcacccgtgatacctcaaagaaccaattttttctgcaactgaatagcgtaactccagaggacacagccacatatttctgcgccactgggtattactatggctcaggtttctggggtcagggcactctcgtcaccgtcagcagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcaccgacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 285 - DNA, 1341 bp, Artificial Sequence
  Description of Artificial Sequence: Synthetic polynucleotide
caggtccaactgcaagagagcggaccgggcctggtaaagccatccgacacattgtccctgacgtgtgcggtaagtggaaactctatcactagcgactatgcgtggaattggataagacaaccgccgggcaaggggctggaatggataggatatatcagctattccggttctacgacatacaatccttccctgaaaagcagagtcactatgtcacgcgacacgtccaagaatcagttctcattgaaattgtcatccgtaacggccgttgacactgcggtttattattgcgcaaccggatattactacggctctggtttttggggacagggaacacttgttactgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagagcctctccctgtctccgggtaaa

SEQ ID NO: 286-291 - skipped (6 entries)

SEQ ID NO: 292 - DNA, 1356 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgcggacacggccgtgtattactgtgcggggactacgatttttggagtggttacccccaacttctactacggtatggacgtctggggccaagggaccacggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 293 - DNA, 1350 bp, Artificial Sequence
  Description of Artificial Sequence: Synthetic polynucleotide
gaggtgcagctggtggagtctgggggaggcgtggtccagcctgggaggtccctgagactctcctgtgtagcctctggattcaccttcagtagttatgacatacactgggtccgccaggctccaggcaaggggctggagtgggtggcaattatttcatatgatggaagtaaaaaagactatacagactccgtgaagggccgattcaccatctccagagacaattccaagaacacgctgtatctgcaaatggacagcctgagagttgaggactcggctgtgtattcctgtgcgagagaaagtggctggtcccactactactattacggtatggacgtctggggccaagggacaatggtcaccgtctcttcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 294 - DNA, 1338 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactattggagctggctccggcagcccgccgggtcgggactggagtggattgggcgtttatatgtcagtgggttcaccaactacaacccctccctcaagagtcgagtcaccttgtcactagacccgtccaggaaccagttgtccctgaaactgagttctgtgaccgccgcggacacggccgtatattattgtgcgggagatagtgggaactactggggttggttcgacccctggggccagggaaccctggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 295 - DNA, 1353 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcatttatatcatatgatggaagtaataaatactatgcagactccgtgaagggccgattcaccatctccagagacaattccaagaacacgctgtatctgcaaatgaacagcctgagagctgaggacacggctgtgtattactgtgcccacctcccttatagtgggagctactgggcctttgactactggggccagggaacccaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcagatggcagcaggggaacgtcttctcatgctccgtgatgcatgaggctctgcacaaccactacacgcagaagagcctctccctgtctccgggtaaa

SEQ ID NO: 296 - DNA, 654 bp, Artificial Sequence
  Description of Artificial Sequence: Synthetic polynucleotide
gacattgtgctgacacagagtccagcatccttggcagtatctttggggcagcgggcaacaatttcatgccgtgcatctgaaagtgtggagtattttggaacttctcttatgcactggtatcgccagaagcctgggcagcctcccaaactccttatatatgccgcttccaacgtggagtccggagtaccagcacgcttttccggctctgggtccggcacagacttttccctcaatatccaacctgttgaagaagacgatttttccatgtatttttgccaacagacacgcaaggttccatatacattcggcggcggcactaaacttgagatcaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 297 - DNA, 654 bp, Artificial Sequence
  Description of Artificial Sequence: Synthetic polynucleotide
gacatagtcttgactcagagcccggattcccttgctgtgtctctgggagaacgagctacgatcaactgcaaggcaagtgaatccgtagaatacttcgggacatcattgatgcattggtatcaacagaaaccggggcaaccgcccaaattgctgatatatgcggctagtaatagagaatcaggagtaccggataggtttagtggttcaggatcaggtacagatttcaccctgacaataagtagcttgcaagccgaagacgtagcagtgtattactgccaacaaacccgaaaggtgccatatacgtttggacagggtacaaagttggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 298-302 - skipped (5 entries)

SEQ ID NO: 303 - DNA, 642 bp, Artificial Sequence
  Description of Artificial Sequence: Synthetic polynucleotide
gatattcaaatgacccagtcaccatcattcctgtccgcctcagtgggagatcgcgtcactattacttgtcgtgctagccaggggatatcatcatatttggcttggtatcaacaaaagccaggaaaggccccaaaattccttatatatgcagctagtacactccagagtggtgttcctagccggttctctggcagcggctcagggaccgagttcaccctgacaatctccagcttgcagcccgaagactttgcaacctactattgccagcaactgaactcctatcctctgactttcgggggaggaaccaaggttgagattaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 304 - DNA, 642 bp, Artificial Sequence
  Description of Artificial Sequence: Synthetic polynucleotide
gatattgtaatgactcagtcaccctcttcactgagtgcatcagtaggtgatcgcgttaccatcacttgccgtgccagtcaagacatttcaaattaccttgcatggtaccaacaaaagcccggaaaagtgccaaagtttttgatttatgccgcttcaacactccattcaggagtgccctctcgtttcagtggatctggcagtggcaccgattttactctcacaataagcagtctccagcctgaggatgtagccacctattattgccaaaaatataattcagccccctatacttttggacagggcacacgccttgagattaaacggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 305 - DNA, 636 bp, Artificial Sequence
  Description of Artificial Sequence: Synthetic polynucleotide
tcctatgagctgactcagccaccctcagtgtccgtgtccccaggagagacagccagcatcacctgctctggagatcaattgggggaaaattatgcttgctggtatcagcagaagccaggccagtcccctgtgttggtcatctatcaagatagtaagcggccctcagggatccctgagcgattctctggctccaactctgggaacacagccactctgaccatcagcgggacccaggctctggatgaggctgactattactgtcaggcgtgggacaacagtattgtggtattcggcggagggaccaagctgaccgtcctaggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 306 - DNA, 645 bp, Artificial Sequence
  Description of Artificial Sequence: Synthetic polynucleotide
cagtctgtgctgactcagccaccctcggtgtcagtggcccccgggcagacggccagtattacctgtgggggagacaacattggaagtaaaagtgtgcactggtaccagcagaagccaggccaggcccctgtgctggtcgtctatgataatagcgaccggccctcagggatccctgagcgattctctggctccaactctgggaccacggccaccctgaccatcagcagggtcgaagccggggatgaggccgactattactgtcaggtgtgggatagtagtagtgatcatcctgtggtattcggcggagggaccaaggtcaccgtcctaggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 307 - skipped

SEQ ID NO: 308 - protein, 253 aa, Artificial Sequence
  Description of Artificial Sequence: Synthetic polypeptide
QVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSGGSEGKSSGSGSESKSTGGSSSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 309 - protein, 107 aa, Homo sapiens [sequence omitted]

SEQ ID NO: 310 - skipped

SEQ ID NO: 311 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 312 - DNA, 642 bp, Artificial Sequence
  Description of Artificial Sequence: Synthetic polynucleotide
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaagcggacagtggccgctccttccgtgttcatcttcccaccttccgacgagcagctgaagtccggcacagcttctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 313 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 314 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 315 - DNA, 642 bp, Artificial Sequence
  Description of Artificial Sequence: Synthetic polynucleotide
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 316 - protein, 253 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGGSEGKSSGSGSESKSTGGSQVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSS

SEQ ID NO: 317 - DNA, 648 bp, Artificial Sequence
  Description of Artificial Sequence: Synthetic polynucleotide
cagtctgctctgacccagcctgcctccgtgtctggctctcccggccagtccatcaccatcagctgtaccggcacctcctccaacatcggcacctacaagttcgtgtcctggtatcagcagcaccccgacaaggcccccaaagtgctgctgtacgaggtgtccaagcggccctctggcgtgtcctccagattctccggctccaagtctggcaacaccgcctccctgaccatcagcggactgcaggctgaggaccaggccgactaccactgtgtgtcctacgctggctctggcaccctgctgtttggcggaggcaccaagctgaccgtgctgggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 318 - protein, 248 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSDIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIK

SEQ ID NO: 319 - protein, 248 aa, Artificial Sequence
  Description of Artificial Sequence: Synthetic polypeptide
DIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIKGGSEGKSSGSGSESKSTGGSQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 320 - protein, 248 aa, Artificial Sequence
  Description of Artificial Sequence: Synthetic polypeptide
QVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 321 - protein, 248 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSS

SEQ ID NO: 322 - protein, 248 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 323 - protein, 248 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 324 - protein, 249 aa, Artificial Sequence
  Description of Artificial Sequence: Synthetic polypeptide
QVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSGGSEGKSSGSGSESKSTGGSQSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTV

SEQ ID NO: 325 - protein, 249 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVGGSEGKSSGSGSESKSTGGSQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSS

SEQ ID NO: 326 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 327 - protein, 475 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 328 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIK

SEQ ID NO: 329 - protein, 243 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 330 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIK

SEQ ID NO: 331 - protein, 243 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 332 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIK

SEQ ID NO: 333 - protein, 243 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 334 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIK

SEQ ID NO: 335 - protein, 243 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 336 - protein, 243 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIK

SEQ ID NO: 337 - protein, 243 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSS

SEQ ID NO: 338 - protein, 432 aa, Artificial Sequence
  Description of Artificial Sequence: Synthetic polypeptide
FKIPIEELEDRVFVNCNTSITWVEGTVGTLLSDITRLDLGKRILDPRGIYRCNGTDIYKDKESTVQVHYRMGSADDAKKDAAKKDDAKKDDAKKDGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGLNDIFEAQKIEWHE

SEQ ID NO: 339 - protein, 426 aa, Artificial Sequence
  Description of Artificial Sequence: Synthetic polypeptide
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMGSGSLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTFPPSQEEMTKNQVSLRCLVKGFYPSDIAVEWESNGQPENNYKTTKPVLDSDGSFRLESRLTVDKSRWQEGNVFSCSVMHEALHNHYTQKSLSLSGGHHHHHH

SEQ ID NO: 340 - protein, 805 aa, Artificial Sequence
  Description of Artificial Sequence: Synthetic polypeptide
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGSADDAKKDAAKKDDAKKDDAKKDGSQSIKGNHLVKVYDYQEDGSVLLTCDAEAKNITWFKDGKMIGFLTEDKKKWNLGSNAKDPRGMYQCKGSQNKSKPLQVYYRMGGGSDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGSHHHHHHHH

SEQ ID NO: 341 - protein, 9 aa, Homo sapiens
PQYPGSEIL

SEQ ID NO: 342 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDILLTQSPGILSVSPGERVSFSCRARQSIGTAIHWYQQRTNGSPRLLIKYASESISGIPSRFSGSGSGTDFTLTINSVESEDIADYYCQQSNSWPYTFGGGTKLEIKGPGGQHHHHHHGAYPYDVPDYAS

SEQ ID NO: 343 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSLQPEDFATYYCQQSNSWPYTFGQGTKLEIKGPGGQHHHHHHGAYPYDVPDYAS

SEQ ID NO: 344 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSLQPEDFATYYCQQSNSWPYTFGQGTKLEIKGPGGQHHHHHHGAYPYDVPDYAS

SEQ ID NO: 345 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSVQPEDFATYYCQQSNSWPYTFGQGTKLEIKGPGGQHHHHHHGAYPYDVPDYAS

SEQ ID NO: 346 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSVQPEDFATYYCQQSGSWPYTFGQGTKLEIKGPGGQHHHHHHGAYPYDVPDYAS

SEQ ID NO: 347 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGPGGQHHHHHHGAYPYDVPDYAS

SEQ ID NO: 348 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGPGGQHHHHHHGAYPYDVPDYAS

SEQ ID NO: 349 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGPGGQHHHHHHGAYPYDVPDYAS

SEQ ID NO: 350 - protein, 262 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGTEGKSSGSGSESKSTDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGPGGQHHHHHHGAYPYDVPDYAS

SEQ ID NO: 351 - protein, 479 aa, Artificial Sequence
  Description of Artificial Sequence: Synthetic polypeptide
EIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKRLEWIGYISYSGSTTYNPSLKSRVTISRDTSKNQFSLKLSSVTAADTAVYYCATGYYYGSGFWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 352 - protein, 482 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKGGSEGKSSGSGSESKSTGGSEVQLVESGGGLVQPGGSLRLSCAASGFTFSSYWMTWVRQAPGKGLEWVANIKQDGSERYYVDSVKGRFTISRDNAKNSLYLQMNSLRAEDTAVYYCARDQNYDILTGHYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 353 - protein, 481 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVLGGSEGKSSGSGSESKSTGGSQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 354 - protein, 454 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 355 - protein, 448 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 356 - protein, 452 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 357 - protein, 484 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGGSEGKSSGSGSESKSTGGSQVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 358 - protein, 445 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 359 - protein, 449 aa, Artificial Sequence
  Description of Artificial Sequence: Synthetic polypeptide
QVQLQQSGPRLVRPSQTLSLTCAISGDSVFNNNAAWSWIRQSPSRGLEWLGRTYYRSKWLYDYAVSVKSRITVNPDTSRNQFTLQLNSVTPEDTALYYCARGYSSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 360 - protein, 474 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 361 - protein, 455 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 362 - protein, 475 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 363 - DNA, 1437 bp, Artificial Sequence
  Description of Artificial Sequence: Synthetic polynucleotide
gagattgttctcacccaatccccagctactctctctctttcacccggtgagcgggcaaccctctcctgtagagccagcgagagcgtggagtattttggcacatccctgatgcactggtatcagcaaaaaccaggacaaccccccagactcctcatatatgccgcctcaaatgtcgagagtgggatacctgcacggttttcaggaagcggcagcggtactgacttcacattgactatatcctctgtagagccagaggattttgcagtctacttctgccagcaaactaggaaggttccatatacttttgggggcggtacaaaagttgagataaagggcggctccgagggcaagagcagcggcagcggcagcgagagcaagagcaccggcggcagccaagtacagctccaggagtcaggacctgggctcgtcaaaccatctcagacattgtccctgacatgcacagtttccggcaacagtattacttccgactatgcttggaattggatcaggcaattcccaggaaagcggctcgagtggataggttatatttcttactctggatctactacctacaatcccagtttgaagtctcgcgtgacaattagccgggacacatcaaaaaatcaattctcacttaaacttagttctgtaaccgctgccgatacagccgtgtactactgcgccactggttattattatggaagcggattttgggggcaaggaactttggtgaccgtctcttccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 364 - DNA, 1356 bp, Artificial Sequence
  Description of Artificial Sequence: Synthetic polynucleotide
gaggtacaacttgtcgaaagtggcggtggagtcgtccagcctgggcgatcacttcgcctctcctgtgtagcctctggtttcactttctcatcttacgacatacactgggtccgccaggcacctggtaaggggctggagtgggttgccatcattagttacgatggctccaaaaaagattacaccgatagcgtaaagggcagatttaccatttccagggataattcaaagaacaccctgtatctgcaaatggacagcctccgcgtcgaagactctgcagtttatagctgtgccagggagtcaggctggtcccattattactattatggtatggacgtttggggccagggaaccatggtcactgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 365 - DNA, 1443 bp, Artificial Sequence
  Description of Artificial Sequence: Synthetic polynucleotide
cagagcgtacttacccagcctcccagcgtgtctgtagccccaggacagacagccagtattacatgcggtggtgacaatataggttccaaatccgtgcattggtaccagcagaagccagggcaagctcccgtgctcgtggtatatgataattccgaccgcccttccggcattcccgaacggtttagtggttcaaattcaggcaccacagcaactctgaccataagcagagtcgaagctggagacgaagccgactactactgtcaggtatgggactctagtagtgaccaccctgtcgtcttcggtgggggaaccaaagtgaccgttctgggcggctccgagggcaagagcagcggcagcggcagcgagagcaagagcaccggcggcagccaggtccagctcgtagaaagtgggggcggcgtagttcagccaggcaggagtctccggctgagttgtgcagccagcggctttactttttcctactatggaatgcactgggtacgtcaggcacccggcaaaggtttggagtgggtcgcattcatttcttatgatggatcaaataagtattatgccgatagtgtaaagggcagatttacaataagtcgagacaactcaaagaacactctctacctccaaatgaatagtcttcgggcagaggatactgcagtgtactattgtgctcatcttccttattccggttcttactgggcattcgattattgggggcaagggacacaagttaccgtgtctagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 366 - DNA, 1452 bp, Artificial Sequence
  Description of Artificial Sequence: Synthetic polynucleotide
agcagcgaattgacccaaccaccttccgtcagcgtcgcaccagggcaaaccgcccgcatcacatgcggtgggaacaatataggaagcaaatctgtccactggtaccagcaaaaaccaggacaagcccctgttctggtcgtctatgatgacagcgacagaccaagtggtattcccgagagattctccggtagcaactctggaaatacagctactttgaccatctccagagttgaggctggtgacgaggcagattactattgccaggtctgggacagctccagcgaccacgtcgtattcggtggcgggaccaagctgactgtgctgggcggctccgagggcaagagcagcggcagcggcagcgagagcaagagcaccggcggcagccaggtgcagttggtagagtcaggagggggcctcgttcaacctggtggcagcctccgtttgtcttgtgctgccagtggatttactttcagtcactacgcaatgagctgggtgagacaagcacctggcaagggccttgagtgggtctccactatcggcggttcaggggggagcacttactacgctgactctgtaaaaggtcgctttactatatctagagataactctaaaaacacactctacttgcagatgaacagcctgcgagccgaagatacagccgtgtactactgcgccaagcctcatattgtaatggtcactgccctcttgtatgatggcatggatgtttggggccaagggacaatggtgacagtctcaagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 367 - DNA, 1362 bp, Artificial Sequence
  Description of Artificial Sequence: Synthetic polynucleotide
caggttcaacttcaagaatccgggccaggtctggtcaagccttcagagactttgtcccttacttgcacagtgagcggtggctctatctcaagttactactggtcatggatacggcagcccccaggaaaggggcttgagtggattgggtacatttattactcagggtcaacaaactacaatccctccctcaaatcccgagtgacaattagtgtcgatacatctaaaaaccagttttccctgaaattgagctcagtcaccgcagctgatactgcagtctattattgtgctggcacaacaatcttcggggtagtaactccaaacttctactacgggatggacgtgtgggggcaaggaacaaccgtaacagtaagtagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 368 - DNA, 1356 bp, Artificial Sequence; identical to SEQ ID NO: 364
  Description of Artificial Sequence: Synthetic polynucleotide

SEQ ID NO: 369 - DNA, 1344 bp, Artificial Sequence
  Description of Artificial Sequence: Synthetic polynucleotide
caagtacaacttcaagagtctggccctgggcttgttaagccctcagagaccttgtcactgacctgtaccgtatcaggcgggtcaatttcatcttactactggagttggcttcgtcagcctgccggatctggactggagtggataggtagactgtatgtttccggctttacaaattacaacccatctttgaaaagccgtgtgactctcagcctcgacccttctcggaatcaactttcacttaaattgtcttctgttacagctgccgacactgcagtatattattgtgcaggggactcaggcaactattggggatggtttgatccttgggggcaggggaccctggtaaccgtgagttctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 370 - DNA, 1365 bp, Artificial Sequence
  Description of Artificial Sequence: Synthetic polynucleotide
caggttcagctgcaagagtctggccctggcctggtcaagccttccgagacactgtctctgacctgcaccgtgtctggcggctccatctcctcctactactggtcctggatcagacagcctcctggcaaaggcctggaatggatcggctacatctactactccggctccaccaactacaaccccagcctgaagtccagagtgaccatctccgtggacacctccaagaaccagttctccctgaagctgtcctccgtgaccgctgctgataccgccgtgtactattgtgctggcaccaccatcttcggcgtggtcacccctaacttctactacggcatggacgtgtggggccaaggcacaacagtgacagtctcttctgcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 371 - DNA, 1335 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 372 - DNA, 1347 bp, Artificial Sequence
  Description of Artificial Sequence: Synthetic polynucleotide
caggtgcagctccaacagagtggtcccagactcgtgagaccctctcaaacactcagtttgacttgtgccatctcaggcgattcagttttcaacaacaatgcagcttggagctggattaggcagtcacctagtcgcggtcttgaatggcttgggcgtacatactatcgctctaaatggttgtatgattacgctgtgtccgtgaagagccgaatcaccgtaaaccctgatacctccaggaatcagttcacattgcaactgaatagtgtgactcccgaggatactgcactctattattgtgcccgaggatatagcagtagcttcgactattggggacaagggacactcgttaccgttagttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 373 - DNA, 1422 bp, Artificial Sequence
  Description of Artificial Sequence: Synthetic polynucleotide
gacatacaaatgacacaatcaccctcttctctttctgcaagcgttggcgaccgtgtcactatcacttgtcgagcccgccagtccataggtactgccattcactggtatcaacagaagcctggcaaggctcccaaactcctgattaagtatgccagcgagagcatttccggcgtaccttcaagattttccggctccggtagtgggacagatttcactctcactatatctagcctccaaccagaagatttcgccacttactactgtcaacaatcaggttcatggccttacactttcggccaggggacaaaattggagatcaagggcggctccgagggcaagagcagcggcagcggcagcgagagcaagagcaccggcggcagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 374 - DNA, 1425 bp, Artificial Sequence
  Description of Artificial Sequence: Synthetic polynucleotide
gacatccagatgacccagtctccatcctctctgtccgcctctgtgggcgacagagtgaccattacctgccgggccagacagtctatcggcaccgctatccactggtatcagcagaagcctggcaaggcccctaagctgctgattaagtacgcctccgagtccatctccggcgtgccctccagattttctggctctggatctggcaccgactttaccctgacaatctccagcctgcagcctgaggacttcgccacctactactgtcagcagtccggctcttggccttacacctttggtcagggcaccaagctggaaatcaagggcggatctgagggaaagtccagcggctccggcagcgaaagcaagtccaccggcggaagcgaggtgcagctggttgaatctggcggaggactggttaagcctggcggctctctgagactgtcttgtgctgcttctggcttcaccttcagccggtacaacatgaactgggtccgacaggctcctggcaaaggcctggaatgggtgtcctccatctccacctccagcaactacatctactacgccgactccgtgaagggcagattcaccttctccagagacaacgccaagaactccctggacctgcagatgtctggcctgagagctgaggacaccgctatctactactgcaccagaggctggggacccttcgattattggggccagggaaccctggtcaccgtgtcatctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 375 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 376 - protein, 475 aa, Artificial Sequence; identical to SEQ ID NO: 362
  Description of Artificial Sequence: Synthetic polypeptide

SEQ ID NO: 377 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 378 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 379 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 380 - protein, 475 aa, Artificial Sequence
  Description of Artificial Sequence: Synthetic polypeptide
DIQMTQSPSSLSASVGDRVTITCRARQSIGTAIHWYQQKPGKAPKLLIYYASESISGVPSRFSGSGSGTDFTLTISSLQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 381 - protein, 475 aa, Artificial Sequence
  Description of Artificial Sequence: Synthetic polypeptide
EVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSGGSEGKSSGSGSESKSTGGSDILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 382 - protein, 475 aa, Artificial Sequence
  Description of Artificial Sequence: Synthetic polypeptide
DILLTQSPGILSVSPGERVSFSCRARQSIGTAIHWYQQRTNGSPRLLIKYASESISGIPSRFSGSGSGTDFTLTINSVESEDIADYYCQQSGSWPYTFGGGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 383 - skipped

SEQ ID NO: 384 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaag

SEQ ID NO: 385 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 386 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaag

SEQ ID NO: 387 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 388 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaag

SEQ ID NO: 389 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 390 - DNA, 729 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaag

SEQ ID NO: 391 - DNA, 729 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagc

SEQ ID NO: 392 - DNA, 729 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcaggcggatctgagggaaagtccagcggctccggcagcgaaagcaagtccaccggcggaagcgacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaa

SEQ ID NO: 393 - DNA, 729 bp, Artificial Sequence
  Description of Artificial Sequence: Synthetic polynucleotide
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaaggcggatctgagggaaagtccagcggctccggcagcgaaagcaagtccaccggcggaagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctca

SEQ ID NO: 394 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 395 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 396 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 397 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 398 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 399 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcgtgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 400 - DNA, 1425 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcggcggatctgagggaaagtccagcggctccggcagcgaaagcaagtccaccggcggaagcgacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaaggagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 401 - DNA, 1425 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatctactacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagggcggatctgagggaaagtccagcggctccggcagcgaaagcaagtccaccggcggaagcgaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 402 - DNA, 1425 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcaggcggatctgagggaaagtccagcggctccggcagcgaaagcaagtccaccggcggaagcgacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 403 - DNA, 1425 bp, Artificial Sequence
  Description of Artificial Sequence: Synthetic polynucleotide
gacatcttgctgactcagtctccaggcatcctgtctgtgagtccaggagaaagagtcagtttctcctgcagggccagacagagcattggcacagccatacactggtatcagcaaagaacaaatggttctccaaggcttctcataaagtatgcttctgagtctatctctgggatcccttccaggtttagcggcagtggatcagggacagattttactcttaccatcaacagtgtggagtctgaagatattgcagattattactgtcaacaaagtgggagctggccgtacacgttcggaggggggaccaagctggaaataaaaggcggatctgagggaaagtccagcggctccggcagcgaaagcaagtccaccggcggaagcgaggtgcaactggtggagtctgggggaggcctggtcaagcctggggggtccctgagactctcctgtgcagcctctggattcaccttcagtagatataacatgaactgggtccgccaggctccagggaaggggctggagtgggtctcatccattagtactagtagtaattacatatactacgcagactcagtgaagggccgattcaccttctccagagacaacgccaagaactcactggatctgcaaatgagcggcctgagagccgaggacacggctatttattactgtacgagaggctgggggccttttgactactggggccagggaaccctggtcaccgtctcctcagagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

SEQ ID NO: 404 - protein, 252 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSGGSEGKSSGSGSESKSTGGSDIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 405 - protein, 252 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKGGSEGKSSGSGSESKSTGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 406 - protein, 250 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSGGSEGKSSGSGSESKSTGGSDIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIK

SEQ ID NO: 407 - protein, 250 aa, Artificial Sequence
  Description of Artificial Sequence: Synthetic polypeptide
DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIKGGSEGKSSGSGSESKSTGGSEVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSS

SEQ ID NO: 408 - protein, 245 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSGGSEGKSSGSGSESKSTGGSSYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVL

SEQ ID NO: 409 - protein, 245 aa, Artificial Sequence
  Description of Artificial Sequence: Synthetic polypeptide
SYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVLGGSEGKSSGSGSESKSTGGSQVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSS

SEQ ID NO: 410 - protein, 267 aa, Artificial Sequence
  Description of Artificial Sequence: Synthetic polypeptide
MAWVWTLLFLMAAAQSIQAQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSDIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIK

SEQ ID NO: 411 - protein, 267 aa, Artificial Sequence
  Description of Artificial Sequence: Synthetic polypeptide
MAWVWTLLFLMAAAQSIQADIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIKGGSEGKSSGSGSESKSTGGSQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 412 - protein, 267 aa, Artificial Sequence
  Description of Artificial Sequence: Synthetic polypeptide
MAWVWTLLFLMAAAQSIQAQVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 413 - protein, 267 aa, Artificial Sequence
  Description of Artificial Sequence: Synthetic polypeptide
MAWVWTLLFLMAAAQSIQAEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSS

SEQ ID NO: 414 - protein, 267 aa, Artificial Sequence
  Description of Artificial Sequence: Synthetic polypeptide
MAWVWTLLFLMAAAQSIQAQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIK

SEQ ID NO: 415 - protein, 267 aa, Artificial Sequence
  Description of Artificial Sequence: Synthetic polypeptide
MAWVWTLLFLMAAAQSIQAEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKGGSEGKSSGSGSESKSTGGSQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSS

SEQ ID NO: 416 - protein, 271 aa, Artificial Sequence
  Description of Artificial Sequence: Synthetic polypeptide
MAWVWTLLFLMAAAQSIQAQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSGGSEGKSSGSGSESKSTGGSDIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 417 - protein, 271 aa, Artificial Sequence
  Description of Artificial Sequence: Synthetic polypeptide
MAWVWTLLFLMAAAQSIQADIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKGGSEGKSSGSGSESKSTGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 418 - protein, 269 aa, Artificial Sequence
  Description of Artificial Sequence: Synthetic polypeptide
MAWVWTLLFLMAAAQSIQAEVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSGGSEGKSSGSGSESKSTGGSDIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIK

SEQ ID NO: 419 - protein, 269 aa, Artificial Sequence
  Description of Artificial Sequence: Synthetic polypeptide
MAWVWTLLFLMAAAQSIQADIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIKGGSEGKSSGSGSESKSTGGSEVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSS

SEQ ID NO: 420 - protein, 264 aa, Artificial Sequence
  Description of Artificial Sequence: Synthetic polypeptide
MAWVWTLLFLMAAAQSIQAQVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSGGSEGKSSGSGSESKSTGGSSYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVL

SEQ ID NO: 421 - protein, 264 aa, Artificial Sequence
  Description of Artificial Sequence: Synthetic polypeptide
MAWVWTLLFLMAAAQSIQASYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVLGGSEGKSSGSGSESKSTGGSQVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSS

SEQ ID NO: 422 - protein, 268 aa, Artificial Sequence
  Description of Artificial Sequence: Synthetic polypeptide
MAWVWTLLFLMAAAQSIQAQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSGGSEGKSSGSGSESKSTGGSQSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTV

SEQ ID NO: 423 - protein, 287 aa, Artificial Sequence
  Description of Artificial Sequence: Synthetic polypeptide
MAWVWTLLFLMAAAQSIQAQSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVGGSEGKSSGSGSESKSTGGSMAWVWTLLFLMAAAQSIQAQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSS

SEQ ID NO: 424 - protein, 253 aa, Artificial Sequence; identical to SEQ ID NO: 308
  Description of Artificial Sequence: Synthetic polypeptide

SEQ ID NO: 425 - protein, 272 aa, Artificial Sequence
  Description of Artificial Sequence: Synthetic polypeptide
MAWVWTLLFLMAAAQSIQASSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGGSEGKSSGSGSESKSTGGSQVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSS

SEQ ID NO: 426 - protein, 471 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSDIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 427 - protein, 471 aa, Artificial Sequence
  Description of Artificial Sequence: Synthetic polypeptide
DIVLTQSPDSLAVSLGERATINCRASESVEYFGTSLMHWYQQKPGQPPKLLIYAASNVESGVPDRFSGSGSGTDFTLTISSLQAEDVAVYFCQQTRKVPYTFGGGTKVEIKGGSEGKSSGSGSESKSTGGSQVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 428 - protein, 471 aa, Artificial Sequence
  Description of Artificial Sequence: Synthetic polypeptide
QVQLQESGPGLVKPSQTLSLTCTVSGNSITSDYAWNWIRQPPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 429 - protein, 471 aa, Artificial Sequence; identical to SEQ ID NO: 428
  Description of Artificial Sequence: Synthetic polypeptide

SEQ ID NO: 430 - protein, 471 aa, Artificial Sequence
  Description of Artificial Sequence: Synthetic polypeptide
QVQLQESGPGLVKPSQTLSLTCTVSGNSITSDYAWNWIRQFPGKGLEWIGYISYSGSTTYNPSLKSRVTISRDTSKNQFSLKLSSVTAADTAVYYCATGYYYGSGFWGQGTLVTVSSGGSEGKSSGSGSESKSTGGSEIVLTQSPATLSLSPGERATLSCRASESVEYFGTSLMHWYQQKPGQPPRLLIYAASNVESGIPARFSGSGSGTDFTLTISSVEPEDFAVYFCQQTRKVPYTFGGGTKVEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 431 - protein, 471 aa, Artificial Sequence; identical to SEQ ID NO: 430
  Description of Artificial Sequence: Synthetic polypeptide

SEQ ID NO: 432 - protein, 475 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSGGSEGKSSGSGSESKSTGGSDIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 433 - protein, 475 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKGGSEGKSSGSGSESKSTGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 434 - protein, 473 aa, Artificial Sequence
  Description of Artificial Sequence: Synthetic polypeptide
EVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSGGSEGKSSGSGSESKSTGGSDIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIKTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 435 - protein, 473 aa, Artificial Sequence
  Description of Artificial Sequence: Synthetic polypeptide
DIVMTQSPSSLSASVGDRVTITCRASQDISNYLAWYQQKPGKVPKFLIYAASTLHSGVPSRFSGSGSGTDFTLTISSLQPEDVATYYCQKYNSAPYTFGQGTRLEIKGGSEGKSSGSGSESKSTGGSEVQLVESGGGVVQPGRSLRLSCVASGFTFSSYDIHWVRQAPGKGLEWVAIISYDGSKKDYTDSVKGRFTISRDNSKNTLYLQMDSLRVEDSAVYSCARESGWSHYYYYGMDVWGQGTMVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 436 - protein, 468 aa, Artificial Sequence
  Description of Artificial Sequence: Synthetic polypeptide
QVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSGGSEGKSSGSGSESKSTGGSSYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVLTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 437 - protein, 468 aa, Artificial Sequence
  Description of Artificial Sequence: Synthetic polypeptide
SYELTQPPSVSVSPGETASITCSGDQLGENYACWYQQKPGQSPVLVIYQDSKRPSGIPERFSGSNSGNTATLTISGTQALDEADYYCQAWDNSIVVFGGGTKLTVLGGSEGKSSGSGSESKSTGGSQVQLQESGPGLVKPSETLSLTCTVSGGSISSYYWSWLRQPAGSGLEWIGRLYVSGFTNYNPSLKSRVTLSLDPSRNQLSLKLSSVTAADTAVYYCAGDSGNYWGWFDPWGQGTLVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 438 - protein, 472 aa, Artificial Sequence
  Description of Artificial Sequence: Synthetic polypeptide
QVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSGGSEGKSSGSGSESKSTGGSQSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 439 - protein, 472 aa, Artificial Sequence
  Description of Artificial Sequence: Synthetic polypeptide
QSVLTQPPSVSVAPGQTASITCGGDNIGSKSVHWYQQKPGQAPVLVVYDNSDRPSGIPERFSGSNSGTTATLTISRVEAGDEADYYCQVWDSSSDHPVVFGGGTKVTVGGSEGKSSGSGSESKSTGGSQVQLVESGGGVVQPGRSLRLSCAASGFTFSYYGMHWVRQAPGKGLEWVAFISYDGSNKYYADSVKGRFTISRDNSKNTLYLQMNSLRAEDTAVYYCAHLPYSGSYWAFDYWGQGTQVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 440 - protein, 476 aa, Artificial Sequence
  Description of Artificial Sequence: Synthetic polypeptide
QVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSGGSEGKSSGSGSESKSTGGSSSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 441 - protein, 476 aa, Artificial Sequence
  Description of Artificial Sequence: Synthetic polypeptide
SSELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGGSEGKSSGSGSESKSTGGSQVQLVESGGGLVQPGGSLRLSCAASGFTFSHYAMSWVRQAPGKGLEWVSTIGGSGGSTYYADSVKGRFTISRDNSKNTLYLQMNSLRAEDTAVYYCAKPHIVMVTALLYDGMDVWGQGTMVTVSSTSTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 442 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 443 - protein, 104 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 444 - protein, 106 aa, Artificial Sequence
  Description of Artificial Sequence: Synthetic polypeptide
SYELTQPPSVSVSPGETASITCSGDQLGENYASWYQQKPGQSPVLVIYQDSKRPSGIPERFSGSNSGNTATLTISGTQALDEADYYCQAWDNSIVVFGGGTKLTVL

SEQ ID NO: 445 - protein, 212 aa, Artificial Sequence
  Description of Artificial Sequence: Synthetic polypeptide
SYELTQPPSVSVSPGETASITCSGDQLGENYASWYQQKPGQSPVLVIYQDSKRPSGIPERFSGSNSGNTATLTISGTQALDEADYYCQAWDNSIVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 446 - DNA, 636 bp, Artificial Sequence
  Description of Artificial Sequence: Synthetic polynucleotide
agttatgagctgactcaaccacccagtgtcagcgtatccccaggagaaactgcctctataacatgcagcggagaccagttgggagaaaattacgcctcctggtaccaacagaagcctggacaaagtcctgtcctcgttatttatcaagattctaaacgtccctctgggatccccgaacgattctccggctctaactctgggaataccgctaccttgacaataagtggtacacaggcacttgatgaagctgattattactgccaggcatgggataacagcattgtggttttcgggggcggcaccaaactcacagttctcggtcagcccaaggctgcacccagtgtcactctgttcccgccctcctctgaggagcttcaagccaacaaggccacactggtgtgtctcataagtgacttctacccgggagccgtgacagtggcctggaaggccgatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 447 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 448 - protein, 9 aa, Homo sapiens
GSDEDHLSL

SEQ ID NO: 449 - protein, 6 aa, Homo sapiens
PRGSKP

SEQ ID NO: 450 - DNA, 642 bp, Artificial Sequence
  Description of Artificial Sequence: Synthetic polynucleotide
gacatccagatgacccagtctccttccttcctgtctgcatctgtaggagacagagtcaccatcacttgccgggccagtcagggcattagcagttatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 451 - DNA, 642 bp, Artificial Sequence
  Description of Artificial Sequence: Synthetic polynucleotide
gacatcgtgatgacccagtctccatcctccctgtctgcatctgtaggagacagagtcaccatcacttgccgggcgagtcaggacattagcaattatttagcctggtatcagcagaaaccagggaaagttcctaagttcctgatctatgctgcatccactttgcactctggggtcccatctcggttcagtggcagtggatctgggacagatttcactctcaccatcagcagcctgcagcctgaagatgttgcaacttattactgtcaaaagtataacagtgccccgtacacttttggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 452 - DNA, 642 bp, Artificial Sequence
  Description of Artificial Sequence: Synthetic polynucleotide
gacatccagatgacccagagcccaagcagcctgagcgccagcgtcggcgaccgcgtgaccatcacctgtcgtgcccgccagagcatcggcaccgccatccactggtaccagcagaagccaggcaaggccccaaagctgctgatcaagtacgccagcgagagcatcagcggtgtgccaagccgcttcagcggcagcggcagcggcaccgacttcaccctgaccatcagcagcctgcagccagaggacttcgccacctactactgccagcagagcggcagctggccatacaccttcggccagggcaccaagctggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 453 - protein, 475 aa, Artificial Sequence
  Description of Artificial Sequence: Synthetic polypeptide
DIQMTQSPSSLSASVGDRVTITCRARQSIGTAIHWYQQKPGKAPKLLIKYASESISGVPSRFSGSGSGTDFTLTISSVQPEDFATYYCQQSGSWPYTFGQGTKLEIKGGSEGKSSGSGSESKSTGGSEVQLVESGGGLVKPGGSLRLSCAASGFTFSRYNMNWVRQAPGKGLEWVSSISTSSNYIYYADSVKGRFTFSRDNAKNSLDLQMSGLRAEDTAIYYCTRGWGPFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 454 - protein, 240 aa, Artificial Sequence
  Description of Artificial Sequence: Synthetic polypeptide
VPLIEGRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHYSEKVTEFMLCAGLWTGGKDTCGGDSGGPLVCNGVLQGITSWGPEPCALPEKPAVYTKVVHYRKWIKDTIAANPHHHHHH

SEQ ID NO: 455 - protein, 6 aa, Artificial Sequence
  Description of Artificial Sequence: Synthetic peptide
GFTFSH

SEQ ID NO: 456 - protein, 17 aa, Artificial Sequence
  Description of Artificial Sequence: Synthetic peptide
TAVYYCAKPHIVMVTAL

SEQ ID NO: 457 - protein, 13 aa, Artificial Sequence
  Description of Artificial Sequence: Synthetic peptide
YDDSDRPSGIPER

SEQ ID NO: 458 - protein, 5 aa, Artificial Sequence
  Description of Artificial Sequence: Synthetic peptide
FTFSY

SEQ ID NO: 459 - protein, 8 aa, Artificial Sequence
  Description of Artificial Sequence: Synthetic peptide
GSYWAFDY

SEQ ID NO: 460 - protein, 4 aa, Artificial Sequence
  Description of Artificial Sequence: Synthetic peptide
DNSD

SEQ ID NO: 461 - protein, 9 aa, Artificial Sequence
  Description of Artificial Sequence: Synthetic peptide
GNSITSDYA

SEQ ID NO: 462 - protein, 4 aa, Artificial Sequence
  Description of Artificial Sequence: Synthetic peptide
GFTF

SEQ ID NO: 463 - protein, 9 aa, Artificial Sequence
  Description of Artificial Sequence: Synthetic peptide
ARDQNYDIL

SEQ ID NO: 464 - protein, 5 aa, Artificial Sequence
  Description of Artificial Sequence: Synthetic peptide
VTPNF

SEQ ID NO: 465 - protein, 9 aa, Artificial Sequence
  Description of Artificial Sequence: Synthetic peptide
YAASTLQSG

SEQ ID NO: 466 - protein, 7 aa, Artificial Sequence
  Description of Artificial Sequence: Synthetic peptide
ESGWSHY

SEQ ID NO: 467 - protein, 244 aa, Artificial Sequence
  Description of Artificial Sequence: Synthetic polypeptide
VPLIEGRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 468 - protein, 451 aa, Artificial Sequence
  Description of Artificial Sequence: Synthetic polypeptide
EVQLVESGGGLVQPGGSLRLSCAASGFTFSSYWMTWVRQPPGKGLEWVANIKQDGSERYFVDSVKGRFTISRDNAKNSLYLQMNSLRAEDTAVYYCARDQNYDILTGHYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 469 - protein, 214 aa, Artificial Sequence
  Description of Artificial Sequence: Synthetic polypeptide
EIVLTQSPSFLSASVGDRVTITCRASQGISSYLSWYQQKPGKAPKLLIYATSTLQSGVPSRFSGSGSGTEFTLTISSLQPEDFATYYCQQLNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 470 - protein, 7 aa, Artificial Sequence
  Description of Artificial Sequence: Synthetic peptide
DDSDRPS

SEQ ID NO: 471 - DNA, 1338 bp, Artificial Sequence
  Description of Artificial Sequence: Synthetic polynucleotide
gaggtgcagctggtggagagcggtggcggtctggtgaagccaggtggcagcctgcgcctgagctgtgccgccagcggtttcaccttcagccgctacaacatgaactgggtgcgccaagccccaggcaagggcctggagtgggtgagcagcatcagcaccagcagcaactacatctactacgccgacagcgtgaagggccgcttcaccttcagccgcgacaacgccaagaacagcctggacctgcagatgagcggtctgcgcgccgaggacaccgccatctactactgcacccgcggttggggcccattcgactactggggccagggcaccctggtgaccgtgagcagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggtaaa

We claim:

1. An isolated anti-hK2/anti-CD3 antibody comprising a first domain that binds hK2 and a second domain that binds CD3, wherein
   a. the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds CD3 comprises the HCDR1, the HCDR2, the HCDR3, the LCDR1, the LCDR2 and the LCDR3 of SEQ ID NOs: 255, 256, 257, 258, 259 and 261, respectively; and/or
   b. the first domain that binds hK2 comprises a VH of SEQ ID NO: 162 and a VL of SEQ ID NO: 163, and the second domain that binds CD3 comprises a scFv of SEQ ID NO: 331; and/or
   c. the isolated anti-hK2/anti-CD3 antibody comprises a HC1 of SEQ ID NO: 354, a LC1 of SEQ ID NO: 221 and a HC2 of SEQ ID NO: 360.

2. The isolated anti-hK2/anti-CD3 antibody of claim 1, wherein the isolated anti-hK2/anti-CD3 antibody comprises a lysine at the C-terminus of HC1 and HC2, and wherein the isolated anti-hK2/anti-CD3 antibody comprises a HC1 which is at least 80% identical to the HC1 of SEQ ID NO: 361 and a HC2 which is at least 80% identical to the HC2 of SEQ ID NO: 362.

3. The isolated anti-hK2/anti-CD3 antibody of claim 1, wherein the first domain that binds hK2 and/or the second domain that binds CD3 comprise a scFv, a (scFv)₂, a Fv, a Fab, or a F(ab')₂.

4. The isolated anti-hK2/anti-CD3 antibody of claim 3, wherein the first domain that binds hK2 comprises a Fab and the second domain that binds CD3 comprises a scFv.

5. The isolated anti-hK2/anti-CD3 antibody of claim 4, wherein the scFv comprises, from N- to C-terminus, a VH, a first linker (L1) and a VL (VH-L1-VL) or the VL, the L1 and the VH (VL-L1-VH).

6. The isolated anti-hK2/anti-CD3 antibody of claim 5, wherein the L1 comprises
   a. about 5-50 amino acids;
   b. about 5-40 amino acids;
   c. about 10-30 amino acids; or
   d. about 10-20 amino acids,
optionally wherein the L1 comprises the amino acid sequence of SEQ ID NO: 7, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, or 108.

7. A pharmaceutical composition comprising the isolated anti-hK2/anti-CD3 antibody of claim 1 and a pharmaceutically acceptable carrier.

8. A method of treating a hK2 expressing cancer in a subject, comprising administering a therapeutically effective amount of the isolated anti-hK2/anti-CD3 antibody of claim 1 to the subject for a time sufficient to treat the hK2 expressing cancer.

9. The method of claim 8, wherein the hK2 expressing cancer is a prostate cancer.

10. An isolated anti-hK2/anti-CD3 antibody comprising a first domain that binds hK2 and a second domain that binds CD3, wherein
    a. the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds CD3 comprises the HCDR1, the HCDR2, the HCDR3, the LCDR1, the LCDR2 and the LCDR3 of SEQ ID NOs: 255, 256, 257, 258, 259 and 261, respectively; and/or
    b. the first domain that binds hK2 comprises a VH of SEQ ID NO: 162 and the VL of SEQ ID NO: 163, and the second domain that binds CD3 comprises a scFv of SEQ ID NO: 331; and/or
    c. the isolated anti-hK2/anti-CD3 antibody comprises a HC1 of SEQ ID NO: 361, a LC1 of SEQ ID NO: 221 and a HC2 of SEQ ID NO: 362.

11. The isolated anti-hK2/anti-CD3 antibody of claim 10, wherein the first domain that binds hK2 and/or the second domain that binds CD3 comprise a scFv, a (scFv)₂, a Fv, a Fab, or a F(ab')₂.

12. The isolated anti-hK2/anti-CD3 antibody of claim 11, wherein the first domain that binds hK2 comprises a Fab and the second domain that binds CD3 comprises a scFv.

13. The isolated anti-hK2/anti-CD3 antibody of claim 12, wherein the scFv comprises, from N- to C-terminus, a VH, a first linker (L1) and a VL (VH-L1-VL) or the VL, the L1 and the VH (VL-L1-VH).

14. The isolated anti-hK2/anti-CD3 antibody of claim 13, wherein the L1 comprises
    a. about 5-50 amino acids;
    b. about 5-40 amino acids;
    c. about 10-30 amino acids; or
    d. about 10-20 amino acids,
optionally wherein the L1 comprises the amino acid sequence of SEQ ID NO: 7, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, or 108.

15. A pharmaceutical composition comprising the isolated anti-hK2/anti-CD3 antibody of claim 10 and a pharmaceutically acceptable carrier.

16. A method of treating a hK2 expressing cancer in a subject, comprising administering a therapeutically effective amount of the isolated anti-hK2/anti-CD3 antibody of claim 10 to the subject for a time sufficient to treat the hK2 expressing cancer.

17. The method of claim 16, wherein the hK2 expressing cancer is a prostate cancer.

18. The isolated anti-hK2/anti-CD3 antibody of claim 1, wherein the isolated anti-hK2/anti-CD3 antibody comprises a lysine at the C-terminus of HC1 and HC2, and wherein the isolated anti-hK2/anti-CD3 antibody comprises a HC1 which is at least 95% identical to the HC1 of SEQ ID NO: 361 and a HC2 which is at least 95% identical to the HC2 of SEQ ID NO: 362.

19. The isolated anti-hK2/anti-CD3 antibody of claim 1, wherein the isolated anti-hK2/anti-CD3 antibody comprises a lysine at the C-terminus of HC1 and HC2, and wherein the isolated anti-hK2/anti-CD3 antibody comprises a HC1 which is at least 99% identical to the HC1 of SEQ ID NO: 361 and a HC2 which is at least 99% identical to the HC2 of SEQ ID NO: 362.

20. The isolated anti-hK2/anti-CD3 antibody of claim 1, wherein the first domain that binds hK2 comprises a VH which is at least 95% identical to the VH of SEQ ID NO: 162 and a VL which is at least 95% identical to the VL of SEQ ID NO: 163, and the second domain that binds CD3 comprises a scFv which is at least 95% identical to the scFv of SEQ ID NO: 331.

21. The isolated anti-hK2/anti-CD3 antibody of claim 1, wherein the first domain that binds hK2 comprises a VH which is at least 99% identical to the VH of SEQ ID NO: 162 and a VL which is at least 99% identical to the VL of SEQ ID NO: 163, and the second domain that binds CD3 comprises a scFv which is at least 99% identical to the scFv of SEQ ID NO: 331.

22. The isolated anti-hK2/anti-CD3 antibody of claim 1, wherein the isolated anti-hK2/anti-CD3 antibody comprises a HC1 which is at least 95% identical to the HC1 of SEQ ID NO: 354, a LC1 which is at least 95% identical to the LC1 of SEQ ID NO: 221 and a HC2 which is at least 95% identical to the HC2 of SEQ ID NO: 360.

23. The isolated anti-hK2/anti-CD3 antibody of claim 1, wherein the isolated anti-hK2/anti-CD3 antibody comprises a HC1 which is at least 99% identical to the HC1 of SEQ ID NO: 354, a LC1 which is at least 99% identical to the LC1 of SEQ ID NO: 221 and a HC2 which is at least 99% identical to the HC2 of SEQ ID NO: 360.

24. The isolated anti-hK2/anti-CD3 antibody of claim 1, wherein:
the first domain that binds hK2 is conjugated to a first immunoglobulin (Ig) heavy chain constant region, or a fragment of the first Ig heavy chain constant region, and
the second domain that binds CD3 is conjugated to a second immunoglobulin (Ig) heavy chain constant region, or a fragment of the second Ig heavy chain constant region.

25. The isolated anti-hK2/anti-CD3 antibody of claim 24, wherein the first Ig heavy chain constant region, or the fragment of the first Ig heavy chain constant region, and the second Ig heavy chain constant region, or the fragment of the second Ig heavy chain constant region, is an IgG1 isotype.

26. The isolated anti-hK2/anti-CD3 antibody of claim 25, wherein the antibody comprises the following amino acid mutations:
L234A_L235A_D265S_T350V_T366L_K392L_T394W in the first Ig heavy chain constant region, or the fragment of the first Ig heavy chain constant region, and
L234A_L235A_D265S_T350V_L351Y_F405A_Y407V in the second Ig heavy chain constant region, or the fragment of the second Ig heavy chain constant region,
wherein numbering of the amino acid mutations is according to the EU index.

27. The isolated anti-hK2/anti-CD3 antibody of claim 24, wherein the first Ig heavy chain constant region, or the fragment of the first Ig heavy chain constant region, comprises an amino acid sequence of SEQ ID NO: 378.

28. The isolated anti-hK2/anti-CD3 antibody of claim 24, wherein the second Ig heavy chain constant region, or the fragment of the second Ig heavy chain constant region, comprises an amino acid sequence of SEQ ID NO: 109.

29. The isolated anti-hK2/anti-CD3 antibody of claim 24, wherein:
the first Ig heavy chain constant region, or the fragment of the first Ig heavy chain constant region, comprises an amino acid sequence of SEQ ID NO: 378, and
the second Ig heavy chain constant region, or the fragment of the second Ig heavy chain constant region, comprises an amino acid sequence of SEQ ID NO: 109.

30. The isolated anti-hK2/anti-CD3 antibody of claim 24, wherein:
the first Ig heavy chain constant region, or the fragment of the first Ig heavy chain constant region, comprises an amino acid sequence which is at least 95% identical to SEQ ID NO: 378, and
the second Ig heavy chain constant region, or the fragment of the second Ig heavy chain constant region, comprises an amino acid sequence which is at least 95% identical to SEQ ID NO: 109.

31. The isolated anti-hK2/anti-CD3 antibody of claim 24, wherein:
the first Ig heavy chain constant region, or the fragment of the first Ig heavy chain constant region, comprises an amino acid sequence which is at least 99% identical to SEQ ID NO: 378, and
the second Ig heavy chain constant region, or the fragment of the second Ig heavy chain constant region, comprises an amino acid sequence which is at least 99% identical to SEQ ID NO: 109.

32. The isolated anti-hK2/anti-CD3 antibody of claim 29, wherein:
the first domain that binds hK2 is conjugated to a first immunoglobulin (Ig) light chain constant region, or a fragment of the first Ig light chain constant region, and
the first immunoglobulin (Ig) light chain constant region, or the fragment of the first Ig light chain constant region, comprises an amino acid sequence of SEQ ID NO: 309.

33. The isolated anti-hK2/anti-CD3 antibody of claim 30, wherein:
the first domain that binds hK2 is conjugated to a first immunoglobulin (Ig) light chain constant region, or a fragment of the first Ig light chain constant region, and
the first immunoglobulin (Ig) light chain constant region, or the fragment of the first Ig light chain constant region, comprises an amino acid sequence which is at least 95% identical to SEQ ID NO: 309.

34. The isolated anti-hK2/anti-CD3 antibody of claim 31, wherein:
the first domain that binds hK2 is conjugated to a first immunoglobulin (Ig) light chain constant region, or a fragment of the first Ig light chain constant region, and
the first immunoglobulin (Ig) light chain constant region, or the fragment of the first Ig light chain constant region, comprises an amino acid sequence which is at least 99% identical to SEQ ID NO: 309.

35. The isolated anti-hK2/anti-CD3 antibody of claim 10, wherein:
the first domain that binds hK2 is conjugated to a first immunoglobulin (Ig) heavy chain constant region, or a fragment of the first Ig heavy chain constant region, and
the second domain that binds CD3 is conjugated to a second immunoglobulin (Ig) heavy chain constant region, or a fragment of the second Ig heavy chain constant region.

36. The isolated anti-hK2/anti-CD3 antibody of claim 35, wherein the first Ig heavy chain constant region, or the fragment of the first Ig heavy chain constant region, and the second Ig heavy chain constant region, or the fragment of the second Ig heavy chain constant region, is an IgG1 isotype.

37. The isolated anti-hK2/anti-CD3 antibody of claim 36, wherein the antibody comprises the following amino acid mutations:
L234A_L235A_D265S_T350V_T366L_K392L_T394W in the first Ig heavy chain constant region, or the fragment of the first Ig heavy chain constant region, and
L234A_L235A_D265S_T350V_L351Y_F405A_Y407V in the second Ig heavy chain constant region, or the fragment of the second Ig heavy chain constant region,
wherein numbering of the amino acid mutations is according to the EU index.

38. The isolated anti-hK2/anti-CD3 antibody of claim 35, wherein the first Ig heavy chain constant region, or the fragment of the first Ig heavy chain constant region, comprises an amino acid sequence of SEQ ID NO: 378.

39. The isolated anti-hK2/anti-CD3 antibody of claim 35, wherein the second Ig heavy chain constant region, or the fragment of the second Ig heavy chain constant region, comprises an amino acid sequence of SEQ ID NO: 109.

40. The isolated anti-hK2/anti-CD3 antibody of claim 35, wherein:
the first Ig heavy chain constant region, or the fragment of the first Ig heavy chain constant region, comprises an amino acid sequence of SEQ ID NO: 378, and
the second Ig heavy chain constant region, or the fragment of the second Ig heavy chain constant region, comprises an amino acid sequence of SEQ ID NO: 109.

41. The isolated anti-hK2/anti-CD3 antibody of claim 35, wherein:
the first Ig heavy chain constant region, or the fragment of the first Ig heavy chain constant region, comprises an amino acid sequence which is at least 95% identical to SEQ ID NO: 378, and
the second Ig heavy chain constant region, or the fragment of the second Ig heavy chain constant region, comprises an amino acid sequence which is at least 95% identical to SEQ ID NO: 109.

42. The isolated anti-hK2/anti-CD3 antibody of claim 35, wherein:
the first Ig heavy chain constant region, or the fragment of the first Ig heavy chain constant region, comprises an amino acid sequence which is at least 99% identical to SEQ ID NO: 378, and
the second Ig heavy chain constant region, or the fragment of the second Ig heavy chain constant region, comprises an amino acid sequence which is at least 99% identical to SEQ ID NO: 109.

43. The isolated anti-hK2/anti-CD3 antibody of claim 40, wherein:
the first domain that binds hK2 is conjugated to a first immunoglobulin (Ig) light chain constant region, or a fragment of the first Ig light chain constant region, and
the first immunoglobulin (Ig) light chain constant region, or the fragment of the first Ig light chain constant region, comprises an amino acid sequence of SEQ ID NO: 309.

44. The isolated anti-hK2/anti-CD3 antibody of claim 41, wherein:
the first domain that binds hK2 is conjugated to a first immunoglobulin (Ig) light chain constant region, or a fragment of the first Ig light chain constant region, and
the first immunoglobulin (Ig) light chain constant region, or the fragment of the first Ig light chain constant region, comprises an amino acid sequence which is at least 95% identical to SEQ ID NO: 309.

45. The isolated anti-hK2/anti-CD3 antibody of claim 42, wherein:
the first domain that binds hK2 is conjugated to a first immunoglobulin (Ig) light chain constant region, or a fragment of the first Ig light chain constant region, and
the first immunoglobulin (Ig) light chain constant region, or the fragment of the first Ig light chain constant region, comprises an amino acid sequence which is at least 99% identical to SEQ ID NO: 309.

46. An isolated anti-hK2/anti-CD3 antibody comprising a first domain that binds hK2 and a second domain that binds CD3, wherein the first domain that binds hK2 comprises a HCDR1, a HCDR2, a HCDR3, a LCDR1, a LCDR2 and a LCDR3 of SEQ ID NOs: 170, 171, 172, 173, 174 and 175, respectively, and the second domain that binds CD3 comprises the HCDR1, the HCDR2, the HCDR3, the LCDR1, the LCDR2 and the LCDR3 of SEQ ID NOs: 255, 256, 257, 258, 259 and 261, respectively.

47. The isolated anti-hK2/anti-CD3 antibody of claim 46, wherein the first domain that binds hK2 comprises a VH of SEQ ID NO: 162 and a VL of SEQ ID NO: 163, and the second domain that binds CD3 comprises a scFv of SEQ ID NO: 331.

48. The isolated anti-hK2/anti-CD3 antibody of claim 46, wherein the isolated anti-hK2/anti-CD3 antibody comprises a HC1 of SEQ ID NO: 354, a LC1 of SEQ ID NO: 221 and a HC2 of SEQ ID NO: 360.

49. The isolated anti-hK2/anti-CD3 antibody of claim 46, wherein the isolated anti-hK2/anti-CD3 antibody comprises a HC1 of SEQ ID NO: 361, a LC1 of SEQ ID NO: 221 and a HC2 of SEQ ID NO: 362.

50. The isolated anti-hK2/anti-CD3 antibody of claim 46, wherein:
the first domain that binds hK2 is conjugated to a first immunoglobulin (Ig) heavy chain constant region, or a fragment of the first Ig heavy chain constant region, and
the second domain that binds CD3 is conjugated to a second immunoglobulin (Ig) heavy chain constant region, or a fragment of the second Ig heavy chain constant region.

51. The isolated anti-hK2/anti-CD3 antibody of claim 50, wherein the first Ig heavy chain constant region, or the fragment of the first Ig heavy chain constant region, and the second Ig heavy chain constant region, or the fragment of the second Ig heavy chain constant region, is an IgG1 isotype.

52. The isolated anti-hK2/anti-CD3 antibody of claim 51, wherein the antibody comprises the following amino acid mutations:
L234A_L235A_D265S_T350V_T366L_K392L_T394W in the first Ig heavy chain constant region, or the fragment of the first Ig heavy chain constant region, and
L234A_L235A_D265S_T350V_L351Y_F405A_Y407V in the second Ig heavy chain constant region, or the fragment of the second Ig heavy chain constant region,
wherein numbering of the amino acid mutations is according to the EU index.

53. A pharmaceutical composition comprising the isolated anti-hK2/anti-CD3 antibody of claim 46 and a pharmaceutically acceptable carrier.

54. A method of treating a hK2 expressing cancer in a subject, comprising administering a therapeutically effective amount of the isolated anti-hK2/anti-CD3 antibody of claim 46 to the subject.

55. The method of claim 54, wherein the hK2 expressing cancer is a prostate cancer.

56. An isolated anti-hK2/anti-CD3 antibody comprising a first domain that binds hK2 and a second domain that binds CD3, wherein the first domain that binds hK2 comprises a VH of SEQ ID NO: 162 and a VL of SEQ ID NO: 163, and the second domain that binds CD3 comprises a scFv of SEQ ID NO: 331.

57. The isolated anti-hK2/anti-CD3 antibody of claim 56, wherein the isolated anti-hK2/anti-CD3 antibody comprises a HC1 of SEQ ID NO: 354, a LC1 of SEQ ID NO: 221 and a HC2 of SEQ ID NO: 360.

58. The isolated anti-hK2/anti-CD3 antibody of claim 56, wherein the isolated anti-hK2/anti-CD3 antibody comprises a HC1 of SEQ ID NO: 361, a LC1 of SEQ ID NO: 221 and a HC2 of SEQ ID NO: 362.

59. The isolated anti-hK2/anti-CD3 antibody of claim 56, wherein:
the first domain that binds hK2 is conjugated to a first immunoglobulin (Ig) heavy chain constant region, or a fragment of the first Ig heavy chain constant region, and
the second domain that binds CD3 is conjugated to a second immunoglobulin (Ig) heavy chain constant region, or a fragment of the second Ig heavy chain constant region.

60. The isolated anti-hK2/anti-CD3 antibody of claim 59, wherein the first Ig heavy chain constant region, or the fragment of the first Ig heavy chain constant region, and the second Ig heavy chain constant region, or the fragment of the second Ig heavy chain constant region, is an IgG1 isotype.

61. The isolated anti-hK2/anti-CD3 antibody of claim 60, wherein the antibody comprises the following amino acid mutations:
L234A_L235A_D265S_T350V_T366L_K392L_T394W in the first Ig heavy chain constant region, or the fragment of the first Ig heavy chain constant region, and
L234A_L235A_D265S_T350V_L351Y_F405A_Y407V in the second Ig heavy chain constant region, or the fragment of the second Ig heavy chain constant region, wherein numbering of the amino acid mutations is according to the EU index.

62. A pharmaceutical composition comprising the isolated anti-hK2/anti-CD3 antibody of claim 56 and a pharmaceutically acceptable carrier.

63. A method of treating a hK2 expressing cancer in a subject, comprising administering a therapeutically effective amount of the isolated anti-hK2/anti-CD3 antibody of claim 56 to the subject.

64. The method of claim 63, wherein the hK2 expressing cancer is a prostate cancer.

65. The method of claim 8, wherein the antibody is administered in combination with at least one additional therapeutic, and wherein the at least one additional therapeutic is surgery, chemotherapy, androgen deprivation therapy or radiation, or any combination thereof.

66. The method of claim 9, wherein the antibody is administered in combination with at least one additional therapeutic, and wherein the at least one additional therapeutic is surgery, chemotherapy, androgen deprivation therapy or radiation, or any combination thereof.

67. The method of claim 9, wherein the prostate cancer is relapsed, refractory, malignant or castration resistant prostate cancer, or any combination thereof.

68. The method of claim 67, wherein the antibody is administered in combination with at least one additional therapeutic, and wherein the at least one additional therapeutic is surgery, chemotherapy, androgen deprivation therapy or radiation, or any combination thereof.

69. The method of claim 16, wherein the antibody is administered in combination with at least one additional therapeutic, and wherein the at least one additional therapeutic is surgery, chemotherapy, androgen deprivation therapy or radiation, or any combination thereof.

70. The method of claim 17, wherein the antibody is administered in combination with at least one additional therapeutic, and wherein the at least one additional therapeutic is surgery, chemotherapy, androgen deprivation therapy or radiation, or any combination thereof.

71. The method of claim 17, wherein the prostate cancer is relapsed, refractory, malignant or castration resistant prostate cancer, or any combination thereof.

72. The method of claim 71, wherein the antibody is administered in combination with at least one additional therapeutic, and wherein the at least one additional therapeutic is surgery, chemotherapy, androgen deprivation therapy or radiation, or any combination thereof.

73. The method of claim 54, wherein the antibody is administered in combination with at least one additional therapeutic, and wherein the at least one additional therapeutic is surgery, chemotherapy, androgen deprivation therapy or radiation, or any combination thereof.

74. The method of claim 55, wherein the antibody is administered in combination with at least one additional therapeutic, and wherein the at least one additional therapeutic is surgery, chemotherapy, androgen deprivation therapy or radiation, or any combination thereof.

75. The method of claim 54, wherein the prostate cancer is relapsed, refractory, malignant or castration resistant prostate cancer, or any combination thereof.

76. The method of claim 75, wherein the antibody is administered in combination with at least one additional therapeutic, and wherein the at least one additional therapeutic is surgery, chemotherapy, androgen deprivation therapy or radiation, or any combination thereof.

77. The method of claim 63, wherein the antibody is administered in combination with at least one additional therapeutic, and wherein the at least one additional therapeutic is surgery, chemotherapy, androgen deprivation therapy or radiation, or any combination thereof.

78. The method of claim 64, wherein the antibody is administered in combination with at least one additional therapeutic, and wherein the at least one additional therapeutic is surgery, chemotherapy, androgen deprivation therapy or radiation, or any combination thereof.

79. The method of claim 64, wherein the prostate cancer is relapsed, refractory, malignant or castration resistant prostate cancer, or any combination thereof.

80. The method of claim 79, wherein the antibody is administered in combination with at least one additional therapeutic, and wherein the at least one additional therapeutic is surgery, chemotherapy, androgen deprivation therapy or radiation, or any combination thereof.

81. An isolated anti-hK2/anti-CD3 antibody comprising a HC1 of SEQ ID NO: 354, a LC1 of SEQ ID NO: 221 and a HC2 of SEQ ID NO: 360.

82. A pharmaceutical composition comprising the isolated anti-hK2/anti-CD3 antibody of claim 81 and a pharmaceutically acceptable carrier.

83. A method of treating a hK2 expressing cancer in a subject, comprising administering a therapeutically effective amount of the isolated anti-hK2/anti-CD3 antibody of claim 81 to the subject.

84. The method of claim 83, wherein the hK2 expressing cancer is a prostate cancer.

85. An isolated anti-hK2/anti-CD3 antibody comprising a HC1 of SEQ ID NO: 361, a LC1 of SEQ ID NO: 221 and a HC2 of SEQ ID NO: 362.

86. A pharmaceutical composition comprising the isolated anti-hK2/anti-CD3 antibody of claim 85 and a pharmaceutically acceptable carrier.

87. A method of treating a hK2 expressing cancer in a subject, comprising administering a therapeutically effective amount of the isolated anti-hK2/anti-CD3 antibody of claim 85 to the subject.

88. The method of claim 87, wherein the hK2 expressing cancer is a prostate cancer.

89. The method of claim 83, wherein the antibody is administered in combination with at least one additional therapeutic, and wherein the at least one additional therapeutic is surgery, chemotherapy, androgen deprivation therapy or radiation, or any combination thereof.

90. The method of claim 84, wherein the antibody is administered in combination with at least one additional therapeutic, and wherein the at least one additional therapeutic is surgery, chemotherapy, androgen deprivation therapy or radiation, or any combination thereof.

91. The method of claim 84, wherein the prostate cancer is relapsed, refractory, malignant or castration resistant prostate cancer, or any combination thereof.

92. The method of claim 91, wherein the antibody is administered in combination with at least one additional therapeutic, and wherein the at least one additional therapeutic is surgery, chemotherapy, androgen deprivation therapy or radiation, or any combination thereof.

93. The method of claim 87, wherein the antibody is administered in combination with at least one additional therapeutic, and wherein the at least one additional therapeutic is surgery, chemotherapy, androgen deprivation therapy or radiation, or any combination thereof.

94. The method of claim 88, wherein the antibody is administered in combination with at least one additional therapeutic, and wherein the at least one additional therapeutic is surgery, chemotherapy, androgen deprivation therapy or radiation, or any combination thereof.

95. The method of claim 88, wherein the prostate cancer is relapsed, refractory, malignant or castration resistant prostate cancer, or any combination thereof.

96. The method of claim 95, wherein the antibody is administered in combination with at least one additional therapeutic, and wherein the at least one additional therapeutic is surgery, chemotherapy, androgen deprivation therapy or radiation, or any combination thereof.

\* \* \* \* \*

UNITED STATES PATENT AND TRADEMARK OFFICE
CERTIFICATE OF CORRECTION

PATENT NO. : 12,077,585 B2
APPLICATION NO. : 16/937285
DATED : September 3, 2024
INVENTOR(S) : Rajkumar Ganesan et al.

Page 1 of 3

It is certified that error appears in the above-identified patent and that said Letters Patent is hereby corrected as shown below:

In the Specification

Under Column nos. 171-172, Line no. 17 (TABLE 4), Replace:
"YWYSGSTNYNPSLKS"
With:
--YIYYSGSTNYNPSLKS--

Under Column nos. 195-196, Line no. 17 (TABLE 11), Replace:
"AASTQSGVPSR"
With:
--AASTLQSGVPSR--

Under Column nos. 241-242, Line no. 6 (TABLE 26-continued), Replace:
"GSGIDFILTIS"
With:
--GSGTDFTLTIS--

Under Column nos. 241-242, Line no. 8 (TABLE 26-continued), Replace:
"VSSLST"
With:
--VSSIST--

Under Column nos. 241-242, Line no. 9 (TABLE 26-continued), Replace:
"CTRCGPFDYWGQGTLNTVSS"
With:
--CTRGWGPFDYWGQGTLVTVSS--

Under Column nos. 275-276, Line no. 4 (TABLE 33), Replace:
"PGINKP"

Signed and Sealed this
Twenty-first Day of October, 2025

John A. Squires
*Director of the United States Patent and Trademark Office*

With:
--PGLVKP--

Under Column nos. 275-276, Line no. 6 (TABLE 33), Replace:
"YGNIDV"
With:
--YGMDV--

Under Column nos. 277-278, Line no. 16 (TABLE 33-continued), Replace:
"CNHKPS"
With:
--CNVNHKPS--

Under Column nos. 277-278, Line no. 21 (TABLE 33-continued), Replace:
"GNVESCS"
With:
--GNVFSCS--

Under Column nos. 283-284, Line no. 3 (TABLE 37-continued), Replace:
"DGVEVEH"
With:
--DGVEVH--

Under Column nos. 283-284, Line no. 57 (TABLE 37-continued), Replace:
"PEVICVVV"
With:
--PEVTCVVV--

Under Column nos. 283-284, Line no. 61 (TABLE 37-continued), Replace:
"LTNVPPV"
With:
--LTWPPV--

Under Column nos. 285-286, Line no. 28 (TABLE 37-continued), Replace:
"GNNTSCSVMHEALEINHYTQKSL"
With:
--GNVFSCSVMHEALHNHYTQKSL--

Under Column nos. 285-286, Line no. 30 (TABLE 37-continued), Replace:
"DRYTITCRARQSIGTAIIIWY"
With:
--DRVTITCRARQSIGTAIHWY--

Under Column nos. 285-286, Line no. 34 (TABLE 37-continued), Replace:
"EWYSSISTSSNYTYY"

CERTIFICATE OF CORRECTION (continued)
U.S. Pat. No. 12,077,585 B2

With:
--EWVSSISTSSNYIYY--